(12) United States Patent
Zwiebel

(10) Patent No.: US 7,314,723 B2
(45) Date of Patent: Jan. 1, 2008

US007314723B2

(54) METHOD OF IDENTIFYING CHEMICAL AGENTS WHICH STIMULATE ODORANT RECEPTORS OF SENSORY NEURONS

(75) Inventor: Laurence J. Zwiebel, Nashville, TN (US)

(73) Assignee: Vanderbilt University, Nashville, TN (US)

( * ) Notice: Subject to any disclaimer, the term of this patent is extended or adjusted under 35 U.S.C. 154(b) by 337 days.

(21) Appl. No.: 10/954,778

(22) Filed: Sep. 30, 2004

(65) Prior Publication Data

US 2005/0153368 A1    Jul. 14, 2005

Related U.S. Application Data

(63) Continuation-in-part of application No. 10/056,405, filed on Jan. 24, 2002, now Pat. No. 7,166,699.

(60) Provisional application No. 60/264,649, filed on Jan. 26, 2001.

(51) Int. Cl.
*G01N 33/53* (2006.01)
*G01N 33/566* (2006.01)

(52) U.S. Cl. ............... 435/7.1; 435/7.2; 435/69.1; 435/252.3

(58) Field of Classification Search ............. None
See application file for complete search history.

(56) References Cited

U.S. PATENT DOCUMENTS

| | | |
|---|---|---|
| 4,663,346 A | 5/1987 | Coulston et al. |
| 5,011,909 A | 4/1991 | Borovsky et al. |
| 5,030,722 A | 7/1991 | Snyder et al. |
| 5,128,246 A | 7/1992 | Snyder et al. |
| 5,130,253 A | 7/1992 | Borovsky et al. |
| 5,439,821 A | 8/1995 | Borovsky et al. |
| 5,501,976 A | 3/1996 | Borovsky et al. |
| 5,629,196 A | 5/1997 | Borovsky et al. |
| 5,670,354 A | 9/1997 | Burns et al. |
| 5,702,916 A | 12/1997 | Molin et al. |
| 5,759,538 A | 6/1998 | Donovan et al. |
| 5,993,778 A | 11/1999 | Firestein et al. |
| 6,008,046 A | 12/1999 | Ffrench-Constant et al. |
| 6,071,878 A | 6/2000 | Delecluse et al. |
| 6,610,511 B1 | 8/2003 | Carlson |
| 2002/0064817 A1 | 5/2002 | Buck et al. |
| 2003/0045472 A1 | 3/2003 | Axel et al. |
| 2003/0082637 A1 | 5/2003 | Zwiebel |
| 2003/0143679 A1 | 7/2003 | Vosshall et al. |
| 2003/0166013 A1 | 9/2003 | Zwiebel |
| 2003/0186359 A1 | 10/2003 | Vosshall et al. |
| 2004/0003419 A1 | 1/2004 | Carlson |

FOREIGN PATENT DOCUMENTS

WO    WO 03/020913 A2 *  3/2003  ............... 435/69.1

OTHER PUBLICATIONS

Blackwell et al. (2000). Electrophysiological investigation of larval water and potential oviposition chemo-attractants for Anopheles gambiae s.s. Annals of Tropical Medicine & Parasitology. 94(4):389-398.*

Wetzel et al. (2001). Functional expression and characterization of a Drosophila odorant receptor in a heterologous cell system. Proc. Natl. Acad. Sci. USA. 98(16):9377-9380.*

Bentrop, et al.; *An arrestin homolog of blowfly photoreceptors stimulates visual-pigment phosphorylation by activating a membrane-associated protein kinase*; Eur. J. Biochem (1993) 216: 67-73.

Boekhoff, et al.; *Termination of second messenger signaling in olfaction*; Proc. Natl. Acad. Sci.; Jan. 1992; 89: 471-474.

Clyne, et al.; *A Novel Family of Divergent Seven-Transmembrane Proteins: Candidate Odorant Receptors in Drosophila*; Neuron, Feb. 1999; vol. 22, 327-338.

Fox, et al.; *Candidate Odorant Receptors from the Malaria Vector Mosquito, Anopheles Gambiae AND evidence of Down-Regulation in Response to Blood Feeding*; PNAS, vol. 98, No. 25, Dec. 2001, 14693-14697.

Hyde, et al.; *Twenty Drosophila visual system cDNA clones: One is a homolog of human arrestin*; Proc. Natl. Acad. Sci.; Feb. 1990; 87: 1008-1012.

Levine III, et al.; *Isolation of a Novel Visual-System-Specific Arrestin: An In Vivo Substrate for light-Dependent Phosphorylation.*, Mechanisms of Development, Dec. 1990, 1:19-25.

Merrill, et al.; *Visual Arrestins in Olfactory Pathways of Drosophila and the Malaria Vector Mosquito Anopheles Gambiae*; PNAS, vol. 99, No. 3; Feb. 5, 2002; 1633-1638.

Raming, et al.; *Arrestin-Subtypes in Insect Antennae*; Cellular Signaling; 1993; 5: 69-80.

Roman, et al.; *Kurtz, a Novel Nonvisual Arrestin, Is an Essential Neural Gene in Drosophila*; Genetics; Jul. 2000; 155: 1281-1295.

Smith, et al.; *Isolation and structure of an arrestin gene from Drosophila*; Proc. Natl. Acad. Sci; Feb. 1990; 87: 1003-1007.

Smith, et al.; *Isolation and expression of an arrestin cDNA from the horseshoe crab lateral eye*; Journal of Neurochemistry; 1995; 64; 1-12.

Vosshall; *The Molecular Logic of Olfaction in Drosophila*; Chem. Senses (2001) 26: 207-213.

(Continued)

*Primary Examiner*—Christine J. Saoud
*Assistant Examiner*—Jon M Lockard
(74) *Attorney, Agent, or Firm*—Wyatt, Tarrant & Combs, LLP

(57) ABSTRACT

The present invention provides methods for identifying agents which modulate mosquito odorant receptors. The methods disclosed herein use genetic material of mosquito odorant receptors to express those receptors in a foreign host system in which the endogenous receptors have been removed.

7 Claims, 4 Drawing Sheets

OTHER PUBLICATIONS

Vosshall, et al.; *A Spatial Map of Olfactory Receptor Expression in the Drosophila Antenna*; Cell, vol. 96; Mar. 5, 1999; 725-736.

Yamada, et al.; *A 49-Kilodalton Phosphoprotein in the Drosophila Photoreceptor is an Arrestin Homolog*; Science, vol. 248 (Apr. 27, 1990); 483-486.

Vosshall, et al.; International Publication No. WO 00/50566; International Application No. PCT/US00/04995; International; Publication Date: Aug. 31, 2000; International Filing Date: Feb. 25, 2000; Title: *Genes Encoding Insect Odorant Receptors and Uses Thereof*; International Patent Classification: C12N; Published by the World Intellectual Property Organization, International Bureau.

Nighorn, et al.; *Dissecting the Molecular Mechanisms of Olfaction in a Malaria-Vector Mosquito*; PNAS, vol. 99, No. 3; Feb. 5, 2002; 1113-1114.

Dobritsa, et al.; *Integrating the Molecular and Cellular Basis of Odor Coding in the Drosophila Antenna*; Neuron, Mar. 6, 2003, 37: 827-841.

Hill, et al.; *G Protein-Coupled Receptors in Anopheles gambiae*; Science, vol. 298 (Oct. 4, 2002); 176-178, and 58 page on-line supplement.

Wetzel, et al.; *Functional expression and characterization of a Drosophila odorant receptor in a heterologous cell system*, PNAS (Jul. 31, 2001) 98:9377-9380.

Hallem, et al.; *Mosquito Receptor for Human-Sweat Odorant*; Nature (Jan. 15, 2004) 427:212-213. (not considered to be prior art by the applicant).

Fox, et al.; *A Cluster of Candidate Odorant Receptors from the Malaria Vector Mosquito, Anopheles gambiae*; Chem. Senses (2002) 27:453-459.

Wetzel, et al.; *Specificity and Sensitivity of a Human Olfactory Receptor Functionally Expressed in Human Embryonic Kidney 293 Cells and Xenopus Laevis Oocytes*; Journal of Neuroscience (Sep. 1, 1999) 19(17):7426-7433.

Pitts, et al.; *A Highly Conserved Candidate Chemoreceptor Expressed in both olfactory and gustatory tissues in the malaria vector Anopheles gambiae*; PNAS (Apr. 6, 2004) 101:5058-5063. (not considered to be prior art by the applicant).

Hallem et al.; *The Molecular Basis of Odor Coding in the Drosophila Antenna*; Cell (Jun. 25, 2004) 117:965-979. (not considered to be prior art by the applicant).

Pierce et al. (2001). Classical and new roles of B-arrestins in the regulation of G-protein-coupled receptors. Nature Reviews. 2:727-733.

Fukuto et al. (2004). G protein-coupled receptor kinase function is essential for chemosensation in C. elegans. Neuron 42:581-593.

Dolph, P.J. (2002). Arrestin: roles in the life and death of retinal neurons. The Neuroscientist 8(4):347-355.

McDonald et al. (2000). B-arrestin 2: a receptor-regulated MAPK scaffold for the activation of JNK3. Science 290:1574-1577.

Gurevich et al. (1995). Visual arrestin binding to rhodopsin. The Journal of Biological Chemistry. 270(11):6010-6016.

Wells, J.A. (1990). Additivity of mutational effects in proteins. Biochemistry. 29(37):8509-8517.

Ngo et al. (1994). Computational complexity, protein structure prediction, and the Levinthal paradox. In Merz and Le Grand (Eds.) The Protein Folding Problem and Tertiary Structure Prediction. Birkhauser:Boston, pp. 492-495.

Fukuto et al. G protein-coupled receptor kinase function is essential for chemosensation in C. elegans. Neuron. May 2004, vol. 42. No. 4, pp. 581-593.

Merril et al. Visual aarrestins in olfactory pathways of Drosophila and the malaria vector mosquito Anopheles gambiae. Proc. Natl. Acad. Sci. USA. Feb. 2002, vol. 99, No. 3, pp. 1633-1638.

Merril et al. Molecular characterization of arrestin family members in the malaria vector mosquito, Anopheles gambaie. Insect Molecular Biology, Dec. 2003, vol. 12, No. 6, pp. 641-650.

Xu et al. Identification of a distinct family of genes encoding atypical odorant-binding proteins in the malaria vector mosquito, Anopheles gambiae. Insect Molecular Biology. Dec. 2003, vol. 12, No. 6, pp. 549-560.

* cited by examiner

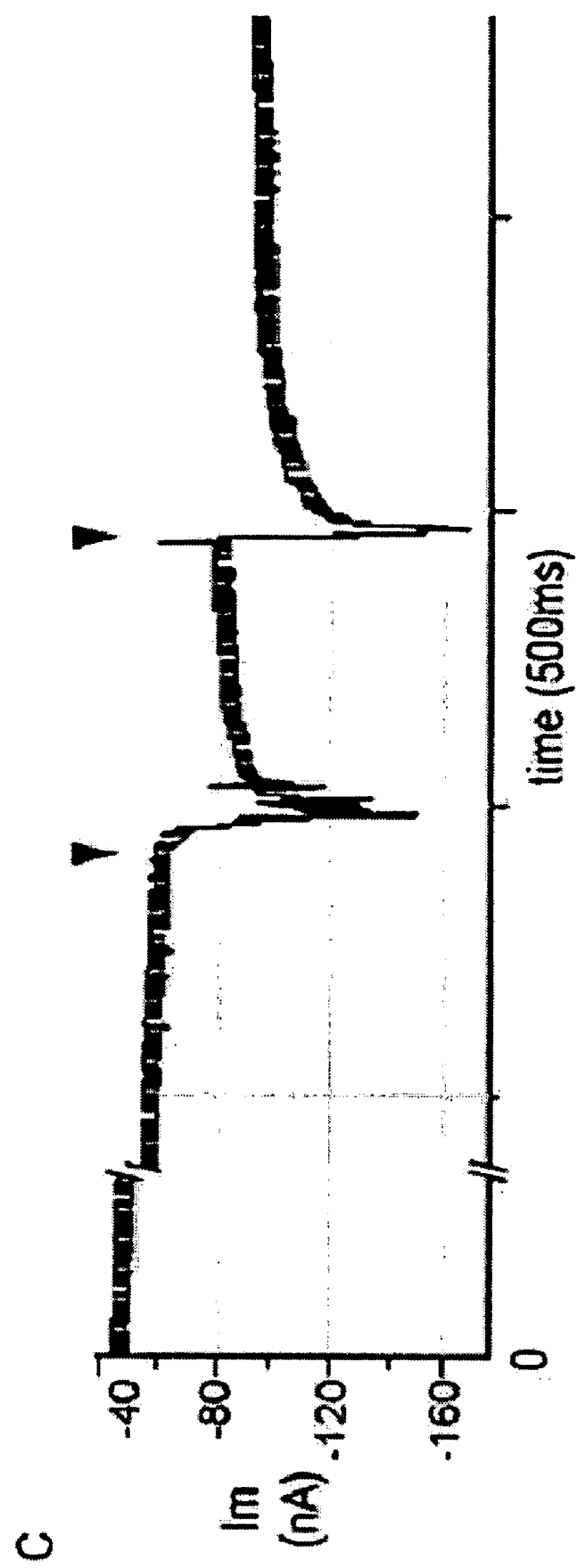

METHOD OF IDENTIFYING CHEMICAL AGENTS WHICH STIMULATE ODORANT RECEPTORS OF SENSORY NEURONS

This application is a continuation-in-part application of U.S. patent application Ser. No. 10/056,405, filed Jan. 24, 2002, now U.S. Pat. No. 7,166,699, entitled "Mosquito Olfactory Genes, Polypeptides, and Methods of Use Thereof," which is hereby incorporated by reference, which claims benefit of U.S. Provisional Patent Application Ser. No. 60/264,649, filed Jan. 26, 2001, entitled "Mosquito Olfactory Genes, Polypeptides, and Methods of Use Thereof" which is hereby incorporated by reference.

Be it known that I, Laurence J. Zwiebel, a citizen of the United States, residing at 2512 Sunset Place, Nashville, Tenn. 37212, has invented a new and useful "Method of Identifying Chemical Agents Which Stimulate Odorant Receptors of Sensory Neurons."

GOVERNMENT SUPPORT CLAUSE

This invention was made with federal grant money under NIH grant R01 DC04692-01 and NSF grant 0075338. The United States Government has certain rights in this invention.

FIELD OF THE INVENTION

The present invention relates generally to the field of host identification by insects. Specifically, the present invention relates to the identification of agents related to the stimulation of mosquito odorant receptors.

BACKGROUND OF THE INVENTION

The ability of an insect to respond to chemical stimuli is necessary for the insect to reproduce and feed. For example, insects respond to certain chemical stimuli by moving up a chemical gradient to identify and target a host. Mosquitoes in particular are believed to use olfaction to identify and target sources of blood meal for reproductive purposes. This behavior contributes to the spread of diseases in humans such as malaria, encephalitis, and dengue fever, as well as animal and live stock diseases.

Olfaction plays a critical role in insect behaviors among agricultural pests and disease factors. The structural and functional characterization of the mosquito olfaction system as continued to be the subject of study. Given the importance of controlling this pest and disease factor, what is needed is the identification of agents which stimulate the mosquito odorant receptors in order to further identify agents which may be used to attract mosquitoes into traps, or agents which may be used to repel mosquitoes away from hosts.

SUMMARY OF THE INVENTION

The present invention provides a method to identify agents that modulate an odorant receptor. Briefly, the method includes the steps of placing an exogenous odorant receptor into a host system, expressing the exogenous odorant receptor in the host system, exposing the exogenous odorant receptor to an agent, and measuring stimulation by way of the odorant receptor.

In certain embodiments of the present invention, the method of identifying a sensory neuron modulating agent includes providing a mosquito odorant receptor, providing a Dipteran neuron, expressing the mosquito odorant receptor in the Dipteran neuron, exposing the mosquito odorant receptor to the agent, wherein the agent is a component of human sweat and measuring stimulation of the neuron. Expressing the mosquito odorant receptor may further include expressing an *Anopheles gambiae* odorant receptor in the Dipteran neuron. Also, exposing the mosquito odorant receptor may further include exposing a plurality of components of sweat to the mosquito odorant receptor. Measuring stimulation may further include recording action potentials wherein an electrode is inserted through a wall of a sensillum. Exposing the mosquito odorant receptor may further include providing the agent in an air stream. Further, providing the agent in the air stream may further include providing the agent in an air stream for from about 0.3 seconds to about 1.0 seconds.

Other embodiments of the present invention include a method of identifying an agent that modulates an odorant receptor, including providing a mosquito odorant receptor operably linked to a promoter, expressing the mosquito odorant receptor in a *Xenopus* neuron, exposing the neuron to the agent, and measuring a stimulation of the odorant receptor. The agent may be a composition from human sweat. The composition from human sweat may be selected from a group consisting of 2-methylphenol, 3-methylphenol, and 4-methylphenol. Additionally, the composition may be any individual of those compositions listed above. Exposing the neuron to the agent may further include providing the agent in a liquid medium. Measuring the stimulation may further include recording action potentials wherein an electrode is inserted in an oocyte.

In still other embodiments, the present invention of a method of identifying an agent that modulates a neuron, includes expressing a mosquito odorant receptor in a Dipteran neuron, exposing the neuron to the agent, measuring an action potential of the neuron, and determining whether the agent modulates the neuron. The method may also include operably linking a nucleic acid encoding the mosquito odorant receptor to a promoter. The promoter may further include the pUAST promoter. The isolated nucleic acid encoding the mosquito odorant receptor may include a sequence of one of the following sequences: SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 237, 239, and 240. In certain embodiments, the isolated nucleic acid encoding the mosquito odorant receptor may include sequence of one of the following sequences: SEQ ID NO: 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, and 236. In other embodiments, the isolated nucleic acid encoding the mosquito odorant receptor may include nucleic acids encoding one of the following amino acid sequences: SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 238, and 241. In still other embodiments, the isolated nucleic acid encoding the mosquito odorant receptor may include nucleic acids encoding a fragment of at least 25 consecutive amino acids of one of the above-mentioned amino acid sequences.

Accordingly, one provision of the present invention is to provide a method for the identification of agents which stimulate mosquito odorant receptors when placed in a different host system.

Still another provision of the present invention is a method of identifying other agents which inhibit or block the stimulation of a mosquito odorant receptor placed in a foreign host system.

Still another provision of the present invention is a method of identifying an agent which stimulates a mosquito odorant receptor when it is placed in a *Drosophila* host system.

Another provision of the present invention is to provide a method for identifying an agent which stimulates a mosquito odorant receptor when placed in a *Xenopus* host system.

Still another provision of the present invention is to provide a method for identification of an agent which may be used to attract mosquitoes toward a trap.

Yet another provision of the present invention is to provide a method for identifying a mosquito repellant.

DESCRIPTION OF THE PREFERRED EMBODIMENTS

Figure 1:
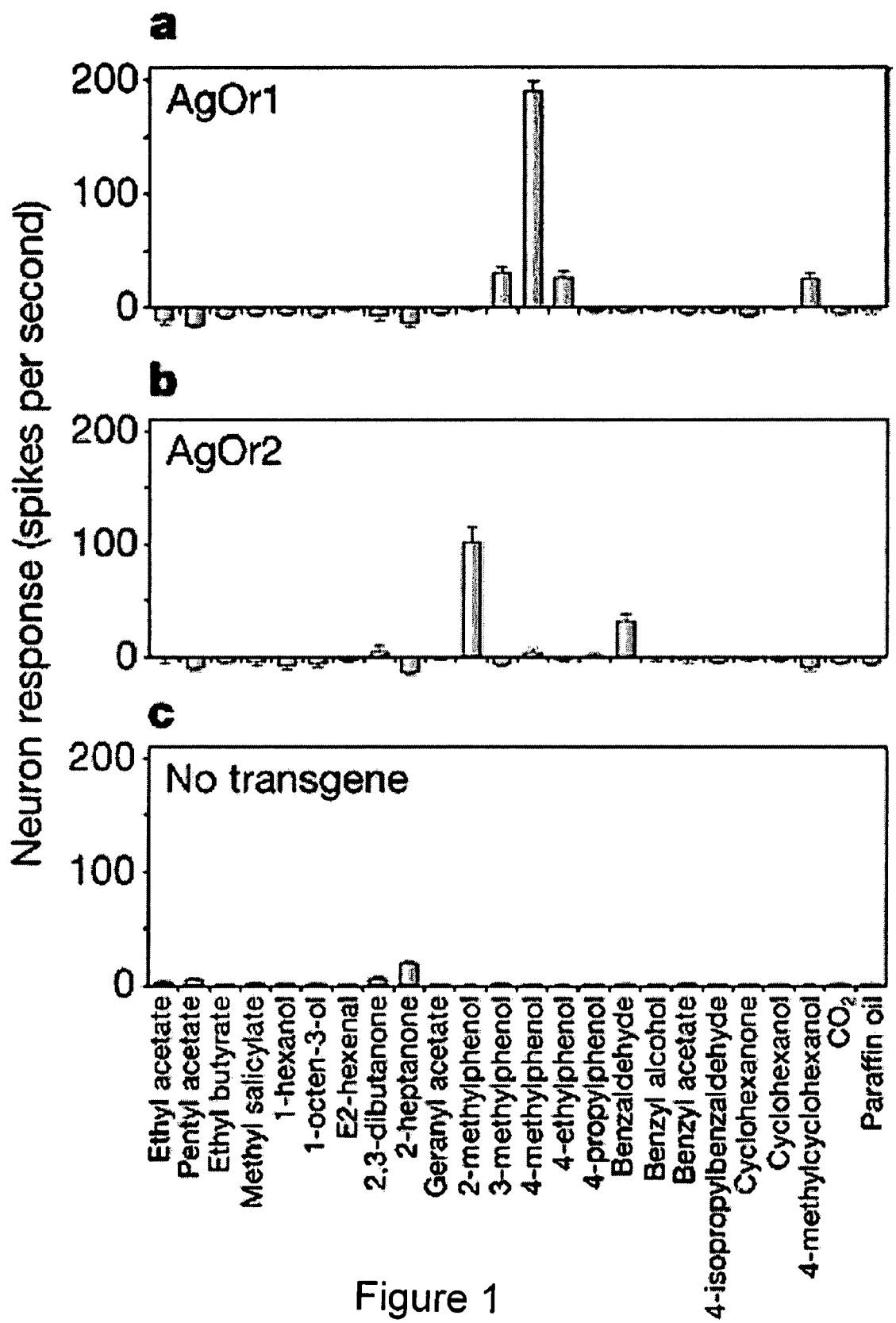
FIG. 1 is a graphical representation of the stimulation of AgOR1 and AgOR2 in a *Drosophila* olfactory neuron. The agents listed are liquid odors deluted to $10^{-4}$ in paraffin oil, and solid odors are deluted to 0.4 Ng/ml. in paraffin oil. Specifically. there is shown the functional characterization of AgOR1/AgOR2 in a *Drosophila* olfactory neuron. ODOR response spectrum conferred by AgOR1 (top panel) and AgOR2 (center panel) to a *Drosophila* olfactory neuron with no transgene (lower panel). Transgenic flies were of the genotype w; Δhalo/Δhalo; UAS-AgOR/Or22a promoter-Gal4. Single-unit recordings were obtained as in[1]. Liquid odors were diluted $10^{-4}$ in paraffin oil, and solid odors were diluted 0.2 ng/ml in paraffin oil.

The present invention relates to a method of identifying an agent that modulates neurons. The method includes expressing a mosquito odorant receptor in a Dipteran neuron, exposing the neuron to the agent, measuring an action potential of the neuron, and determining whether the agent modulates the neuron.

Mosquito odorant receptors are polypeptides that are involved in the modulation of the mosquito olfaction system. By way of illustration, and not limitation, mosquito odorant receptors have the following characteristics: (1) G protein-coupled seven-transmembrane domain receptors, (2) sequence conservation regarding positions of a subset of introns and the length of the deduced protein, (3) they are selectively expressed in olfactory receptor neurons, and (4) they have highly conserved structural motifs. Odorant receptors 3, 4 and 5 are clustered tightly together within the *An. gambaie* genome. Odorant receptor 5 and odorant receptor 4 are separated by 310 bp while odorant receptor 4 and odorant receptor 3 are separated by 747 bp. An additional characteristic of odorant and taste receptor genes is the close chromosomal linkage. Such linkage has been demonstrated in the *D. melanogaster* and odorant receptor genes from *C. elegans* and mouse. Clyne, et al., 1999, Neuron, 22: 327-338; Vosshall, et al., 1999, Cell, 96: 725-736; Vosshall, et al., 2000, Cell, 102: 147-159; Clyne, et al., 2000, Science, 287: 1830-1834; Gao and Chess 1999, Genomics, 60: 31-39; Troemel, et al., 1995, Cell, 83: 207-218; Xie, et al., 2000, Genome, 11: 1070-1080. Fox et. al., 2001, PNAS 98: 14693-14697, hereby incorporated herein by reference in their entirety. This group of mosquito odorant receptors includes, but is not limited to, *Anopheles gambiae* odorant receptors 1-79, and variants thereof as described herein. Genomic, cDNA, and polypeptide sequences of *Anopheles gambiae* odorant receptors are disclosed herein. See also Hill et al., 2002, Science 298: 176-178, hereby incorporated herein by reference in its entirety. Also disclosed herein are sequences for *Anopheles gambiae* Arrestin 1 and 2, which may be used in the disclosed invention. As is well known in the art, the letter N in a nucleotide sequence represents a base that may be an A, C, G, or T. In certain embodiments, the present invention includes nucleotides, or complements thereof, that encode polypeptides sharing at least 75% sequence identity with the peptide sequences in conserved domains, as determined by BLAST (Basic Local Alignment Search Tool) analysis. In the present invention, nucleotide sequences are used to provide proteins which perform functions as described herein. Accordingly, the nucleotide and protein sequences for certain, but not all, genes which may be used are provided herein. Thus, the present invention includes the use of variants of the proteins, and conservative amino acid substitutions of the proteins, meaning at least one alteration that does not disturb the functions of the protein. In alternate embodiments, the nucleotide sequences may be isolated from organisms in addition to *Anopheles gambiae*. Some of the amino acid sequences provided use the one symbol code for the amino acid, which is shown as follows:

| | | |
|---|---|---|
| Alanine | Ala | A |
| Cysteine | Cys | C |
| Aspartic acid | Asp | D |
| Glutamic acid | Glu | E |
| Phenylalanine | Phe | F |
| Glycine | Gly | G |
| Histidine | His | H |
| Isoleucine | Ile | I |
| Lysine | Lys | K |
| Leucine | Leu | L |
| Methionine | Met | M |
| Asparagine | Asn | N |
| Proline | Pro | P |
| Glutamine | Gln | Q |
| Arginine | Arg | R |
| Serine | Ser | S |
| Threonine | Thr | T |
| Valine | Val | V |
| Tryptophan | Trp | W |
| Tyrosine | Tyr | Y |

Accession numbers for the sequences disclosed in this paper include AY062432, AY363725, AF364131, AF364130, which are incorporated herein by reference.

Odorant receptor genes are also known in other systems. Such odorant receptor genes and uses thereof are further described in U.S. Patent Application Publication No. 2003/0186359 filed Aug. 17, 2001, published Oct. 2, 2003, by Vosshall et al.; U.S. Patent Application Publication No. 2003/0143679 filed Jun. 25, 2002, published Jul. 31, 2003, by Vosshall et al.; U.S. Patent Application Publication No. 2003/0045472 filed Feb. 22, 2002, published Mar. 6, 2003 by Axel et al.; U.S. Patent Application Publication No. 2004/0003419, filed May 29, 2003, published Jan. 1, 2004 by Carlson et al.; U.S. Pat. No. 6,610,511 issued Aug. 26, 2003 to Carlson et al.; and U.S. Patent Application Publication No. 2002/0064817 filed Jan. 26, 2001, published May 30, 2002 by Buck et al., all of which are incorporated herein by reference in their entireties.

The present invention provides, in part, an assay to determine which agents stimulate an odorant receptor molecule which is present in a heterologous system. As further described herein, an electrode contacts an individual sensilla which is distinguished by a marker present for sensilla expressing the odorant receptor. Action potentials are compared against control sensilla. Measurement of stimulation may occur in multiple systems, by way of illustration and not limitation, *Drosophila* and *Xenopus*.

Nucleic acid encoding a mosquito odorant receptor is prepared for cloning into a vector and ultimately expression in a host system. The nucleic acid sequences of known *Anopheles gambiae* odorant receptors are disclosed herein. Such nucleic acids may be synthesized or otherwise obtained as known by one of skill in the art. Specific examples of the manner of preparation are disclosed herein.

Genetic Backdrop of *D. melanogaster* and the Odorant System

In order to assess whether an agent stimulates an odorant receptor, it may be beneficial to place the odorant receptor in a system which lacks any odorant receptors. The methods disclosed herein take advantage of a genetic strain of *D. melanogaster* in which a chromosomal deletion has resulted in the loss of the endogenous receptors (DmOR22a/b) from the ab3A odorant receptor neuron (ORN). Dobritsa, et al., 2003, Neuron 37: 827-841, hereby incorporated herein by reference in its entirety. The resultant formation of a so-called "empty neuron," herein called a neuron, system facilitates the specific targeting of exogenous odorant receptor genes that carry a fluorescent tag into the empty neuron thereby allowing electrophysiological assessment of the ability of the novel receptor to carry out chemosensory signal transduction upon stimulation with a diverse set of odorants. Hallem, E., et al., 2004, Nature 427: 212-213 hereby incorporated herein by reference in its entirety. In certain embodiments of the present invention, an *Anopheles gambiae* odorant receptor (hereinafter "AgOR" or "fAgOR"), for example AgOR7, may be introduced into the empty *Drosophila* neuron using the promotor of the endogenous DOR22a gene and the bipartite Gal4-UAS system to drive odorant receptor neuron specific expression of the mosquito odorant receptors.

Referring now to FIG. 1, AgOR2 expression is shown to be responsible for providing selective sensitivity of the neuron to 2-methylphenol (2 MP) while expression of the female specific AgOR1 gene is shown to specifically induce responses to 4-methyl phenol. Hallem, E., et al., 2004, Nature 427: 212-213, hereby incorporated herein by reference in its entirety. In addition to showing that AgORs do indeed encode functional odorant receptor proteins, the fact that 4-methyl phenol has been previously identified as a component of human sweat shows that *An. gambiae* adult females may be particularly responsive to human sweat (Cork, A. & Park, K. C., 1996, Med Vet Entomol. 10: 269-76, hereby incorporated herein by reference in its entirety), is consistent with the hypothesis that female specific expression of AgOR1 imparts a high affinity to 4-methyl phenol, and that may be responsible for at least part of the high degree of anthropophily that underlies the vectorial capacity of *An. gambiae*. The manner of expressing AgOR is described herein below.

Genetic Backdrop of *Xenopus laevis* and the Odorant System

Figure 2A:
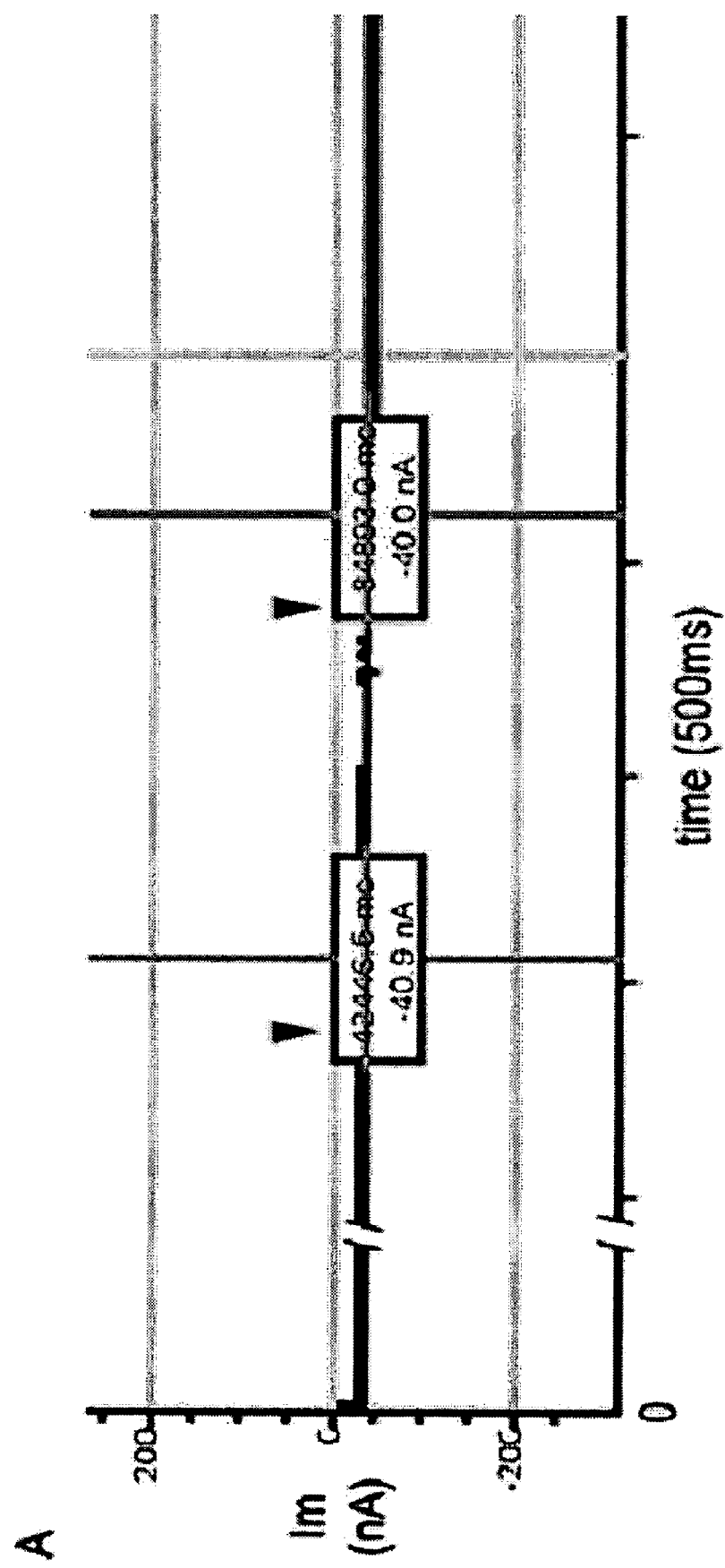
FIG. 2 shows electrode-voltage clamp recordings of *Xenopus* oocytes having either AgOR1 cRNA, or AgOR7 cRNA. Specifically, there is shown the functional characterization of AgOR1/AgOR7 in *Xenopus* oocytes. Two Electrode-voltage clamp recordings of *X. leavis* oocytes injected with 50 ng in vitro synthesized Gα15 cRNA as well as AgOR1 cRNA (B) or with 25 ng AgOR1 and 25 ng AgOR7 cRNA (C). Control oocytes (A) were injected with Gα15 alone. Arrowheads indicate 500 msec stimulus perfusion with $10^{-5}$M 4MP in Ringers buffer.
Figure 2B:
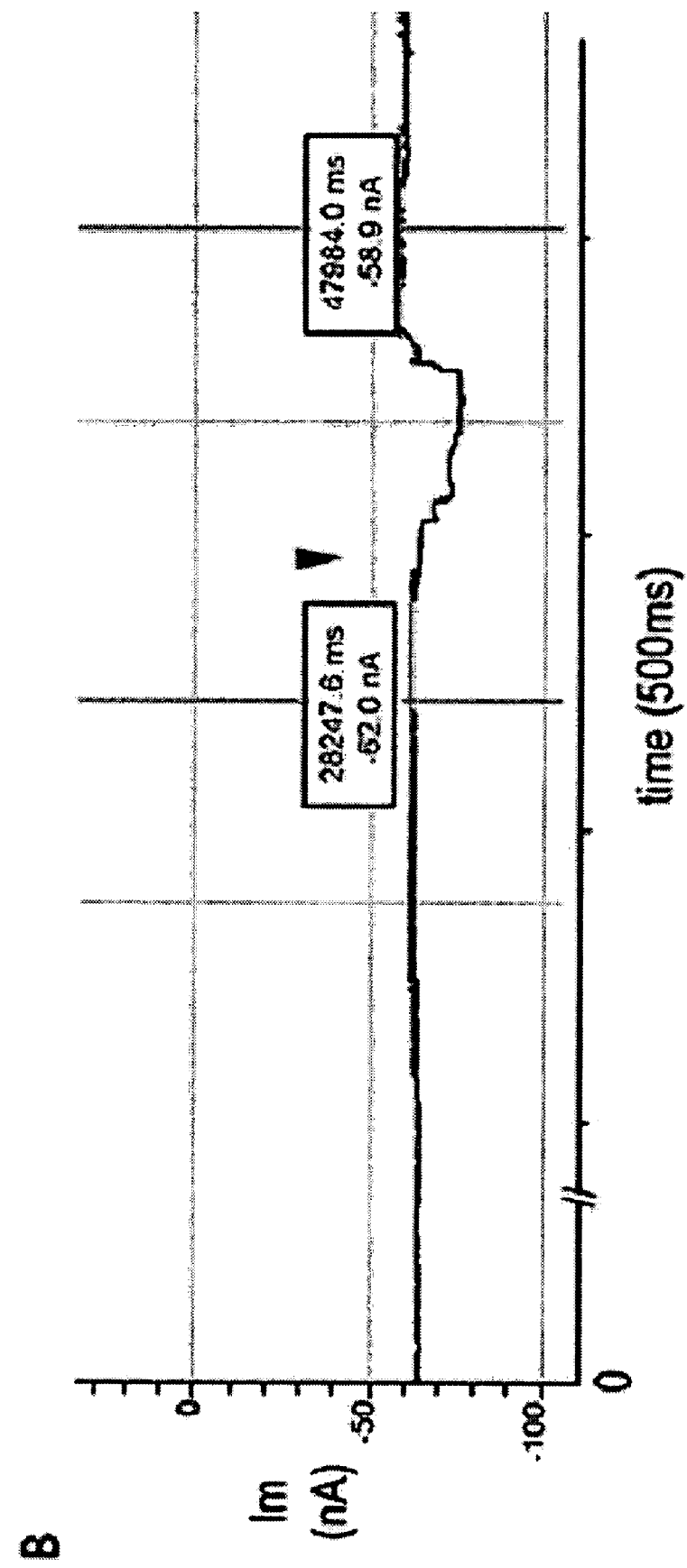

In alternate embodiments, the AgORs may be expressed and functionally characterized using *Xenopus levis* oocyctes. Similar to the *Drosophila* expression platform, in these embodiments, in vitro transcription may be used to generate purified mRNAs encoding, for example, AgOR1, AgOR7 and the general signal transduction partner, $G\alpha15$ that may be subsequently micro-injected into oocytes harvested from female animals. Wetzel, C. H. et al., 2001, PNAS 98: 9377-9380, hereby incorporated herein by reference in its entirety. These cells promote the translation and correct localization of these exogenous proteins to the plasma membrane facilitating the use of voltage clamp electrophysiology to monitor stimulus evoked opening of endogenous ion channels. In these embodiments, as best seen in FIG. 2B, nearly a 20 nA clamp current is specifically induced by $G\alpha15$/perfusion of AgOR1/$G\alpha15$ expressing *Xenopus* oocytes with 4-methyl phenol. Evidence of such inducement is shown since control oocytes, shown in FIG. 2A, display no response to 4-methyl phenol. Further, when oocytes are injected with both AgOR1 and AgOR7, they display a significant enhancement of this stimulus evoked clamp current resulting in an almost 80 nA response, as best seen in FIG. 2C. This suggests there is a functional interaction between these AgOR proteins. Pitts, R. J., et al., 2004, Proc Natl Acad Sci USA 101: 5058-5063, hereby incorporated herein by reference in its entirety. These embodiments show that *Xenopus* may be used as an additional expression platform for the AgOR characterizations that are proposed in this application.

Agents that are Candidates for Odorant Receptor Mediation

The assay disclosed herein may be used to test an agent's ability to stimulate neurons through odorant receptors. Candidate agents for this assay include chemical and other components of perspiration, for example, but not limited to, human sweat, or other bodily excretions from a mammal. The group of candidate agents may also include other components that are associated with mosquitoes. By way of illustration, but not limitation, examples of candidate agents include: Ethyl acetate, Pentyl acetate, Ethyl butyrate, Methyl salicylate, 1 hexanol, 1-octen-3-ol, E2-hexenal, 2,3-dibutanone, 2-heptanone, Geranyl acetate, 2-methylphenol, 3-methylphenol, 4-methylphenol, 4-ethylphenol, 4-propylphenol, Benzaldehyde, Benzyl alcohol, Benzyl acetate, 4-isopropylbenzaldehyde, Cyclohexanone, Cyclohexanol, 4-methylcyclohexanol, (E)-3-methyl-2-hexenoic acid, (Z)-3-methyl-2-hexenoic acid, 7-octenoic acid, Indole, Geranyl acetone, 3-methyl-butanol ammonia, butylamine, pentylamine.

Use of the assay disclosed herein may determine whether the female-specific AgOR genes encode receptors for any of a panel of odorants that may play a role in *An. gambiae* behavior. Accordingly, in addition to the variance of agents that may be tested, the assay may use different genes. The general strategy is to express each female AgOR gene in a *Drosophila* antennal neuron that has lost odor response due to a deletion of its endogenous odor receptor gene Or22a.

Physiological recordings will determine whether expression of a female AgOR (fAgOR) gene in this "receptorless" neuron confers response to any of a panel of odorants that are potentially involved in *An. gambiae* behavior.

Expression of Heterologous Genes in the Odorant Receptor System

In certain embodiments of the present invention, the yeast UAS-GAL4 system may be used to drive expression of each fAgOR gene under the control of the yeast transcription factor GAL4. Perrimon, N., et al., 1991, Dev Genet 12: 238-52, hereby incorporated herein by reference in its entirety. For example, for an fAgOR gene, a UAS-fAgOR plasmid is constructed. The UAS sequence is disclosed herein. In certain embodiments, genomic clones of the fAgOR genes may be used, since they are more convenient to prepare than cDNA clones. Also, as mentioned previously, cDNA sequences of those genes may be used. The corresponding polypeptide sequences are also disclosed. All sequences are disclosed in the sequence listing of this document. As a specific example, an AgOR1 genomic clone is prepared and functions equivalently to an AgOR1 cDNA sequence in this system. In alternate embodiments, a cDNA clone may be used, as prepared through PCR amplification from *An. gambiae* antennal cDNA or via RACE protocols, which are well known in the art. In addition to the above listed sequences, mutant, knock out, or modified sequences thereof are included within the present invention. The nucleotide sequences of all UAS-AgOR clones are confirmed prior to germline transformation.

The UAS-fAgOR plasmids may be introduced into *Drosophila* by standard P element-mediated germline transformation procedures which are standard and well known in the art. Rubin, G. M. & Spradling, A. C., 1982, Science 218: 348-353; see also Published U.S. Patent Application No. 2004/0003419, filed May 29, 2003 by Carlson et al., and published Jan. 1, 2004; see Sambrook et al., 1989, Molecular Cloning—A Laboratory Manual, Cold Spring Harbor Laboratory Press, hereby incorporated herein by reference in their entirety.

As one of ordinary skill in the art knows, many methods are well known in the art for introducing genetic alteration or genetic material into a germ line cell. The genetic material of the recipient may be passed to offspring. As known by one of ordinary skill in the art, transgenic insects are the recipient of recombinant, exogenous or cloned genetic material that has been experimentally transferred. Stated another way, the exogenous genetic material may be foreign to the species or foreign to the particular individual. Also, the genetic material may have a different expression pattern. In certain embodiments, the nucleic acid sequence of the transgene may be integrated at a position of the genome where that particular nucleic acid sequence is not normally found. In alternate embodiments, the nucleic acid sequence of the transgene may be integrated in a position at the normal locus for the transgene. Futher, the transgene may consist of nucleic acid sequences from the genome of the same species or different species of the recipient host.

As mentioned above, transgenic insects can be produced by a variety of different methods. By way of illustration, and not limitation, those methods include P element transformation by microinjection, transformation by microinjection followed by transgene mobilization, electroporation, baculovirus, and adenoviral vectors to express a foreign nucleic acid sequence. Holtmaat et al., 1996, Brain. Res. Mol. Brain Res. 41: 148-156; Rubin & Spradling, 1982, Science 218: 348-353; Orr & Sohal, 1993, Arch. Biochem. Biophys. 301: 34-40; Mockett et al., 1999, Arch. Biochem. Biophys. 371: 260-269; Huynh & Zieler, 1999, J. Mol. Biol. 288: 13-20; Yamao et al., 1999, Genes Dev. 13: 511-516, incorporated herein by reference in their entirety. Many examples of transgenic insects are known in the art. Mockett et al., 1999, Arch. Biochem. Biophys. 371: 260-269; Raeber et al., 1995, Mech. Dev. 51: 317-327; Kolonin & Finley, 1998, Proc. Natl. Acad. Sci. USA 95: 14266-14271; Reynaud et al., 1997, Mol. Gen. Genet. 256: 462-467, all of which are incorporated herein by reference in their entirety. Again, one of ordinary skill in the art knows, or has available, procedures for preparing transgenic insects. Rubin & Spradling, 1982, Science 218: 348-353; Orr & Sohal, 1993, Arch. Biochem. Biophys. 301: 34-40, hereby incorporated herein by reference in their entirety.

The transgene may then be crossed into a stock containing an Or22a promoter-GAL4 construct, and the Δhalo mutation that deletes the endogenous Or22a gene. The Or22a promoter-GAL4 construct drives expression of GAL4 in the ab3A cell of the Δhalo mutant. GAL4 in turn binds to UAS and activates transcription of the fAgOR gene in this cell.

As known by one of ordinary skill in the art, disabling endogenous genes is well known in the art. One of ordinary skill in the art also knows methods of detecting the disabled gene. U.S. Pat. No. 5,759,538, issued Jun. 2, 1998 to Donovan et al., incorporated herein by reference in its entirety.

Sensitivity of fAgOR in the Odorant Receptor System

After expressing the mosquito odorant receptor, to provide a heterologous system, measurement of the stimulation, or modulation, of the neuron, or oocyte is accomplished. Measuring stimulation, or determining whether an agent provides modulation, may be accomplished by many methods which are well known in the art. In certain embodiments, measuring stimulation is provided by single-unit electrophysiology carried out using procedures that are well known and routine to one of ordinary skill in the art. Hallem, E., et al., 2004, Nature 427: 212-213; de Bruyne, M., et al., 1999, J Neurosci 19: 4520-32; de Bruyne, M., et al., 2001, Neuron 30: 537-52, hereby incorporated herein by reference in their entirety. Briefly, a panel of agents is tested, initially at a standard $10^{-2}$ dilution. In certain embodiments, the panel may include thirty compounds that have previously been reported to elicit responses from *An. gambiae* either in field behavior, laboratory behavior, or electrophysiology. By way of illustration, but not limitation, among these are ammonia, $CO_2$, lactic acid, hexanoic acid, and 7-octanoic acid, in addition to others listed above. Additional agents may be tested and considered strong candidate agents if shown to generate strong (>100 spikes/s) responses from individual odorant receptor neurons. Note that the agents may represent diverse chemical classes (e.g. ketones, alcohols, acetate esters). Additional candidate agents are further described herein.

When an agent elicits a response of greater than 200 spikes per second at a $10^{-2}$ dilution from fAgOR-expressing *Drosophila* ab3A neurons, a dose response curve may be generated in order to determine more accurately the sensitivity of the receptor for that agent. In alternate embodiments, both GFP-tagged and untagged versions of the cDNA may be used in the assay. Although not limited by theory, the tagged version will determine whether the fAgOR is expressed and correctly localized to the dendrites of the ab3A neuron and the untagged version is used in case the GFP tag compromises the function of the AgOR. For results see FIGS. 1 and 2. If a particular AgOR yields no response to any tested odorant in this system, which has been the case for 6/30 *Drosophila* odorant receptor genes previously tested by others, the gene may be tested in the *Xenopus* oocyte expression system, which has been successfully used to express a *Drosophila* odorant receptor (Wetzel, C. H. et al., 2001, PNAS 98: 9377-9380, incorporated herein by reference in its entirety) as well as a number of human odorant receptors (Wetzel, C. H. et al., 1999, Journal of Neuroscience 19: 7426-7433, hereby incorporated herein by reference in its entirety).

Additional Candidates that May Modulate Odorant Receptors

In addition to determining whether any agents previously identified by virtue of effects on the *An. gambiae* olfactory system, including some implicated in host-seeking behavior, are ligands for fAgORs, the invention disclosed herein identifies agents that are potent ligands for these receptors, or that block their function. Once such agents are identified, they may be useful as lures in insect traps, and blockers may be useful as insect repellents.

In certain embodiments, the method disclosed herein identifies ligands for fAgORs. Based upon the structural characteristics of the agents that do bind and stimulate fAgORs, other candidate agents having similar structural characteristics may also be tested. For example, if one of the fAgORs responds to hexanoic acid, alternate agents, such as pentanoic acid, heptanoic acid, hexanal, and other structurally related compounds may be tested. One possible outcome is that by testing these structurally related compounds we will identify a molecule that activates an fAgOR more potently than the initially identified compound.

In alternate embodiments, the present invention identifies agents, or ligands, for fAgORs by testing agents selected not on the basis of structure but on practical criteria. Practical criteria include, but are not limited to ease of availability at low cost, structural stability, environmentally safe agents. Agents meeting at least one of these criteria are most likely to be useful in pest control in the field. In certain embodiments of the present invention, agents are initially tested at a $10^{-2}$ dilutions. In alternate embodiments, agents are tested by this method at a range of physiologically relevant concentrations. In still other embodiments, initial testing at $10^{-2}$ dilutions may be followed by testing at physiologically relevant concentrations.

In still other embodiments, the present invention may be used to test naturally occurring odorant mixtures to identify agents that interact with fAgORs. This approach is attractive in two respects. First, it allows convenient screening of a large number of agents from a single source, and it provides a collection of agents that have an increased probability of stimulating fAgORs. Without being limited by mechanism or theory, a suite of candidate agents from human sweat, and other human skin volatiles may be tested. For example, human sweat may be obtained from individuals having known differences in mosquito attractiveness. Smallegange, R. C., Geier, M. & Takken, W. (2002). Behavioural responses of *Anopheles gambiae* to ammonia, lactic acid and a fatty acid in a y-tube olfactometer. *Proceedings of the Section Experimental and Applied Entomology of the Netherlands Entomological Society (NEV)* 13: 147-152, hereby incorporated herein by reference in its entirety. For example, human skin volatiles are collected on glass marbles being held in human hands from individuals with proven attractiveness for *An. gambiae*. Schreck, C. E., et al., 1990, J Am Mosq Control Assoc 6: 406-10; Bernier, U. R., et al., Anal Chem 71: 1-7, hereby incorporated herein by reference in their entirety. In brief, batches of 25 glass beads that are handled for 10 minutes are desorbed in a thermal desorption system (TDS) combined with a cryo-focusing system before each Gas Chromatograph (GC) run. The compounds are subsequently be analyzed by GC-mass spectrometry with an HP5-ms column. These complex mixtures are fractionated by gas chromatography and the effluent directed over the antenna of *Drosophila* expressing fAgOR. Agents that are strong ligands for fAgORs expressed in the empty ab3A neuron may be identified by single-unit electrophysiology, and their molecular structures may be determined by mass spectrometry. Alternately specific agents may be synthesized or purchased from a commercial source, such as Plant Research International in Wageningen, or isolate them using preparative gas chromatography.

Identifying fAgOR Blocking Agents (fAgOR Antagonists)

The present invention may identify agents that block the response of fAgORs to their ligands. Precedent for such antagonists has been documented for a wide variety of G protein coupled receptors, including odorant receptors. Kajiya, K. et al., 2001, J. Neurosci. 21: 6018-6025, hereby incorporated herein by reference in its entirety. One mechanism by which such antagonists could block response is by binding tightly to the receptor but not activating it. For general information related to insect repellents, note U.S. Pat. No. 4,663,346, issued May 5, 1987 to Coulston et al., which is incorporated herein by reference. To identify such antagonists, agents are tested for the characteristic of blocking the response of known ligands for the fAgORs. For each fAgOR, it is possible to test pairwise combinations of odorants: $L_S+X$, where $L_S$ is an agent, or ligand, for an fAgOR, identified as described above, and X is an a second agent whose ability to reduce the response by the first agent ($L_S$) will be tested. In certain embodiments, agents that are structurally related to $L_S$ are tested for their ability to block the response of $L_S$. Such agents are tested first since such agents may bind to the receptor by virtue of their structural similarity to $L_S$, but may not contain structures required to induce conformational changes needed to activate the receptor. In certain embodiments, the $L_S$ dilution which is tested is one that elicits a strong, but non-saturating response, to ensure maximal sensitivity of the blocking assay.

EXAMPLES

Example 1

Cloning of AgOR1 cDNA

Total antennal RNA is isolated from *An. gambiae* G3 adults using the RNeasy® RNA isolation kit (Qiagen, Valencia, Calif.). First strand cDNA synthesis is carried out using ~0.5 µg RNA, and SuperScript II Reverse Transcriptase (RNAseH-) according to the manufacturers protocol (Invitrogen, Carlsbad, Calif.). Full length AgOR1 cDNA is amplified by using PfuTurbo DNA Polymerase (Stratagene, La Jolla Calif.) on each cDNA sample using specifical oligonucleotide primers: Or1 5'A, 5'-ATGAAGCTG AACAACT-GAA-3' (SEQ ID NO: 243); Or1 3', 5'-TTAAGGATATTAA-CACCATT-3' (SEQ ID NO: 244) for 40 cycles with a TM of 60° C. Full length AgOr1cDNAs are gel purified using the QIAQuick gel extraction kit (Qiagen), and are subcloned into the pCRII-TOPO cloning vector (Invitrogen, Carlsbad, Calif.).

Example 2

Expression of AgOR1 in *Drosophila* "Empty Neuron" System

Full length AgOR1 cDNAs are PCR amplified from PCRII-TOPO/AgOR1 clones using Pfu Turbo DNA Polymerase (Stratagene, La Jolla, Calif.) and AgOR1 specific primers that provide specific restriction sites for unidirectional in-frame cloning into the pNmyc-UAST vector, available from John Carlson, Yale University. Dobritsa, A. A., van der Goes van Naters, W., Warr, C. G., Steinbrecht, R. A., and Carlson, J. R. (2003). Integrating the Molecular and Cellular Basis of Odor Coding in the *Drosophila* Antenna. Neuron 37, 827-841, hereby incorporated herein by reference in its entirety. The primers are:

```
AgOR1 5'NotI:                    (SEQ ID NO:245)
5'-GATCGCGGCCGCAAGCTGAACAACTGA-3'

AgOr1 3' Kpn I:                  (SEQ ID NO:246)
5'-GATCGGTACCTTAAGGATATTAACACCATT-3'
```

Germline transformation of Drosophila melanogaster is carried out using P-element mediated transformation with pNmyc-UAST/AgOR1 using standard microinjection protocols commonly used in Drosophila genetics. Spradling, A. C., and Rubin, G. M., 1983, Cell 34:47-57; Rubin and Spradling, 1982, Science 218:348-353; Karess and Rubin, 1984, Cell 38:135-146, hereby incorporated herein by reference. Microinjection capillary pipettes are prepared using a P-97 puller (Sutter Instruments, Novato, Calif.) and deliver approximately 40 ng of vector under the control of a PV830 pneumatic picopump (World Precision Instruments, Sarasota Fla.) for injection into pre-cellular embryos of true-breeding white; Kinked Δ2,3 ($w^{1118}$; K Δ2,3 available from P. Kolodziej, Vanderbilt University) *D. melanogaster* (G0 generation) using a 5Z-10 stereo microscope (Olympus mc, Melville, N.Y.). Individual $w^+$ G1 progeny are laid by injected adults and are crossed to $w^{1118}$ Δhalo embryos (available from M. Welte, Brandeis University/*Drosophila* Stock Center), hereby incorporated herein by reference in their entirety, to yield $w^+$ G2 flies that are in a w; Ki Δ2,3/+; Δhalo background. Male $w^+$ G2 flies are mated to $w^{1118}$, Δhalo females to eliminate the ΔKi Δ2,3 chromosome (by selecting against the dominant Ki marker) and establish true-breeding transgenic stocks of pNmyc-UAST/AgOR1 in a $w^{1118}$; Δhalo background.

In order to specifically express AgOR1 in *Drosophila* ab3A neurons we use the bipartite Gal4-UAS system (Perrimon, N., et al., 1991, Dev Genet 12: 238-252, hereby incorporated herein by reference in its entirety), to drive cell specific expression of the yeast transcription factor GAL4 (by the *Drosophila* Or22a promoter) which in turn activates the pUAST promoter upstream of AgOR1 in ab3A neurons. The pUAST promoter, which is a part of a composite transposon that encompasses 5 copies of the UAS activator sequence that normally lies ahead of yeast genes under the control of the Gal 4 transcription factor, is shown as SEQ ID NO: 22. Brand, A. H., Perrimon, N., Targeted gene expression as a means of altering cell fates and generating dominant phenotypes, *Development* 1993 118(2): 401-415, incorporated herein by reference in its entirety To accomplish this we cross two parental lines of *Drosophila*: Or22a-GAL4 (Dobritsa et al., 2003) and pNmyc-UAST/AgOR1 (generated as described above) to yield a single experimental individual. Assays for transgenic expression of AgOR1 and olfactory function are performed on these progeny using the electro-physiological paradigms described below.

Example 3

Expression of AgOR1 in *Xenopus* Oocytes

Full length AgOR1 cDNAs are PCR amplified from PCRII-TOPO/AgOR1 clones using Pfu Turbo DNA Polymerase (Stratagene, La Jolla Calif.) and AgOR1 specific primers that provide a eukaryotic translation initiation consensus sequence (Kozak, M., 1999, Gene 234:187-208, hereby incorporated herein by reference) and specific restriction sites for unidirectional cloning into pT7Ts vector (available from D. Melton, Harvard University). These oligonucleotide primers are as follows:

```
5' OR1/BglII + Kozak:            (SEQ ID NO:247)
5-AGATCTGCCACCATGAAGCTGAACAAACTGAACC-3'

3' OR1/SpeI:                     (SEQ ID NO:248)
5'-ACTAGTTTACTCTGATTCCATGCTCTGAA-3'
```

RNA for the injection into *Xenopus* oocytes is prepared by in vitro transcription using MMESSAGE MMACHINE® in vitro transcription kit according to the manufacturer's protocol (Ambion Thc, Austin Tex.). Oocytes are surgically collected from female *Xenopus*' ovaries and are prepared for injection with in vitro transcribed RNAs in a volume of approximately 26 nanoliters using a Nanoliter 2000 injector (World Precision Instruments, Sarasota, Fla.) and a Zeiss Stemi 2000 stereo microscope (Carl Zeiss mc, Thomwood, N.Y.) as described (Theodoulou, F. L., and Miller, A. J., 1995, Methods Mol Biol 49:317-340, hereby incorporated herein by reference in its entirety). Once eggs are injected, the eggs are incubated at 18.0° C. for several days in Barth's solution to allow the injected RNA to be translated, transported and for the ORs to be correctly targeted to oocyte membranes. The Barth's solution surrounding the oocytes is changed every 24-48 hours, in order to maximize the health of the injected oocytes.

Example 4

Stimulation of *Drosophila* Olfactory Neurons (Functional Assays of AgORs)

Extracellular electrophysiological recordings are from live *Drosophila* at 20° C. and 40%-60% relative humidity. A fly (2- to 10-day-old) is wedged into the narrow end of a truncated plastic pipette tip and is placed on a slide as in Dobritsa et al., 2003; Hallem, E., et al., 2004, Nature 427: 212-213, hereby incorporated herein by reference in its entirety.

Action potentials of the AgOR-expressing olfactory receptor neurons (ORNs) in a sensillum are recorded by placing an electrode through the sensillum wall into contact with the lymph that bathes the dendrites. The antennal surface is observed at 1200× magnification, which allows individual sensilla to be clearly resolved, through a B×40 microscope (Olympus Inc., Melville, N.Y.) that is fitted with fluorescence optics to view Green Fluorescence Protein (GFP) which is used as a marker to distinguish the AgOR expressing ORNs and act as precise guide for placement of the recording electrode.

Action potentials are recorded by inserting a tungsten wire electrode in the base of a sensillum. The tip of the electrode is thereby brought in contact with the sensillum lymph surrounding the dendrites of the ORNs. The tungsten wire (0.1 mm diameter) is electrolytically sharpened (ca. 1 m tip diameter) by repeated dipping in a 10% NaNO2 solution while passing a 0.3-3 mA current through the solution. The reference electrode is inserted in the eye or at the base of the proboscis.

Signals from the recording electrode are amplified 1000× (Iso-dam, World Precision Instruments, Sarasota, Fla.) and are fed into a computer via a 16-bit Intelligent Data Acquisition Controller (USB-IDAC4, Syntech, Hilversum, The Netherlands) for analysis off-line with AUTOSPIKE software (Syntech, Hilversum, The Netherlands). AC signals (100-10,000 Hz) are recorded for 6 s, starting 2 s before stimulation, and action potentials are counted off-line in a 0.5 s period before stimulation and for 0.5 s during stimulation.

Responses of individual neurons are calculated as the increase (or decrease) in action potential frequency (spikes per second) relative to the pre-stimulus frequency. In some experiments, action potentials are extracted by a computer using the AUTOSPIKE algorithm (Syntech, Hilversum, The Netherlands), which distinguishes their peak-to-trough amplitudes from noise. Extraction is either off-line from the primary data or on-line to monitor the firing frequency of an individual ORN for up to 60 s.

Odor stimuli are presented from Pasteur pipettes holding solutions of chemicals in paraffin oil (Fluka AG, Switzerland) on filter paper. Chemicals >99.5% pure (Fluka and Sigma-Aldrich, St. Louis, Mo.) are diluted to 1% v/v solutions in paraffin oil, whereupon an aliquot of 50 microliters is dropped on a 0.5 inch filter-round which is placed in the shaft of a Pasteur pipette. Stimuli are presented by placing the tip of a Pasteur pipette through a hole in a tube that carries an air stream (37.5 ml/s) over the preparation and redirecting a flow of charcoal filtered and humidified air (3.75 ml/s) by solenoid-controller (CS-55, Syntech, Hilversum, The Netherlands) through the pipette to give a 0.5 s pulse. Fresh stimulus pipettes are prepared after a maximum of three presentations.

Example 5

Stimulation of Xenopus Oocytes (Functional Assays of AgORs)

Following an incubation period of from three to five days, the oocytes are placed in an oocyte perfusion chamber (RC-17, Warner Instruments Inc., Hamden, Conn.) and are monitored through a Zeiss Stemi 2000 stereo microscope (Carl Zeiss Inc, Thornwood, N.Y.) and are linked to a continuous flow bath of Ringer's solution maintained by a High Pressure Chromotography pump (Model 510, Waters Inc., Milford, Mass.). Oocytes are then stably penetrated with KCl filled glass electrodes (which is prepared using a P-97 puller, Sutter Instruments, Novato, Calif.), they are held in place with a set of micromanipulators (Warner Instruments Inc., Hamden, Conn.) and are directly connected to an Oocyte Voltage Clamp electro-physiology apparatus (OC 725C, Warner Instruments Inc., Hamden, Conn.). Data is acquired using an Intel-based personal computer with a digital data interface apparatus (Digidata 1322A, Axon Instruments, Union City, Calif.) and subsequently are analyzed using pCLAMP software (Axon Instruments, Union City, Calif.). The clamp current is monitored digitally and odorants such as 4-methylphenol are introduced in the continuous flow bath using a six channel valve control apparatus (VC-6, Warner Instruments Inc., Hamden, Conn.) and the response is recorded. Wetzel, C. H., et al., 2001, PNAS 98: 9377-9380, hereby incorporated herein by reference in its entirety.

One may prepare, isolate, inject and assay, in Xenopus oocytes, mRNA for AgOR1, AgOR7 and mammalian $G\alpha_{15}$ by the above-listed protocols to facilitate odorant induced stimulation of AgOR receptors.

All references, publications, and patents disclosed herein are expressly incorporated by reference. The results of the experiments disclosed herein have been published in the journal Nature (2004) 427: 212-213, this article herein incorporated by reference in its entirety.

Thus, it is seen that the apparatus and method of the present invention readily achieves the ends and advantages mentioned as well as those inherent therein. While certain preferred embodiments of the invention have been illustrated and described for purposes of the present disclosure, numerous changes in the arrangement and construction of parts may be made by those skilled in the art, which changes are encompassed within the scope and spirit of the present invention as defined by the following claims.

SEQUENCE LISTING (248 sequences)

SEQ ID NO: 1 - protein, 417 aa, Anopheles gambiae
MKLNKLNPRWDAYDRRDSFWLQLLCLKYLGLWPPEDTDQATRNRYIAYGWALRIMFLHLYALTQALYFKDVKDINDIANALFVLMTQVTLIYKLEKFNYNIARIQACLRKLNCTLYHPKQREEFSPVLQSMSGVFWLMIFLMFVAIFTIIMWVMSPAFDNERRLPVPAWFPVDYHHSDIVYGVLFLYQTIGIVMSATYNFSTDTMFSGLMLHINGQIVRLGSMVKKLGHDVPPERQLVATDAEWKEMRKRIDHHSKVYGTMYAKVTECVLFHKDILRFGDEVQDIFQGSIFAQVCASVIIICMTLLQATGDDVTMADLLGCGFYLLVMTSQVFIFCYVGNEISYTTDKFTEFVGFSNYFKFDKRTSQAMIFFLQMTLKDVHIKVGSVLKVTLNLHTFLQIMKLSYSYLAVLQSMESE

SEQ ID NO: 2 - DNA, 1254 bp, Anopheles gambiae
atgaagctgaacaaactgaacccacggtgggatgcgtacgaccgacgggattcgttctggttgcagttgctttgtttgaaatatttgggcctatggccaccggaagatacggatcaggcaacgcggaaccggtacatcgcgtacggttgggctttgcggatcgtgtttctacatctgtacgctctaacgcaagccctatacttcaaggatgtgaaggatattaatgacatcgcaaatgcattgttcgtgcttatgactcaagtgacgttgatctacaagctggaaaagtttaactacaacatcgcacggattcaggcttgtctgcgcaagcttaactgcacactgtatcacccgaaacagcgcgaagaattcagccccgttttacgatcgatgagtggagtgttttggctgatgatctttctcatgtttgtggccatcttcaccatcatcatgtgggttatgtcgccagccttcgacaatgaacgtcgtctgcccgtgccggcctggttcccggtggactatcaccgttcggacatcgtgtacggtgtactgttcctgtatcaaaccattggaatcgtcatgagcgcaacgtacaacttctcgaccgataccatgttttccggcttgatgctacacataaatggacaaattgtgcggcttggtagtatggttaaaaagcttggacatgacgtccctcccgaacgccaattggtcgcaacggatgcggaatggaaagagatgcgaaagcgcatcgaccatcactccaaagtgtacggtacgatgtacgctaaagtaacggagtgtgtgctgtttcacaaggacatcttaagcttcggcgatgaagtgcaggacattttccaaggatctatcttcgcgcaagtatgcgcgtctgtaattatcatttgtatgacactgctgcaagctaccggggacgatgttacgatggccgatctgctgggctgtgggttctatttgctagtaatgacatcgcaagtgtttattttctgttacgtagggaatgaaatctcctatacgacggataaatttacagagtttgttgggttttccaactacttcaagttcgataagcgtaccagccaagcaatgatattttttctgcaaatgactcttaaagatgttcacatcaaggtgggaagtgtcttgaaggttacgctaaatcttcacacatttttgcagattatgaagctatcgtactcctatctggccgtacttcagagcatggaatcagagtaa

SEQ ID NO: 3 - protein, 378 aa, Anopheles gambiae
MLIEECPIIGVNVRVWLFWSYLRRPRLSRFLVGCIPVAVLNVFQFLKLYSSWGDMSELIINGYFTVLYFNLVLRTSFLVINRRKFETFFEGVAAEYALLEKNDDIRPVLERYTRRGRMLSISNLWLGAFISACFVTYPLFVPGRGLPYGVTIPGVDVLATPTYQVVFVLQVYLTFPACCMYIPFTSFYATCTLFALVQIAALKQRLGRLGRHSGTMASTGHSAGTLFAELKECLKYHKQIIQYVHDLNSLVTHLCLLEFLSFGMMLCALLFLLSISNQLAQMIMIGSYIFMILSQMFAFYWHANEVLEQSLGIGDAIYNGAWPDFEEPIRKRLILIIARAQRPMVIKVGNVYPMTLEMFQKLLNVSYSYFTLLRRVYN

SEQ ID NO: 4 - DNA, 1137 bp, Anopheles gambiae
atgctgatcgaagagtgtccgataattggtgtcaatgtgcgagtgtggctgttctggtcgtatctgcggcggccgcggttgtcccgctttctggtcggctgcatcccggtcgccgtgctgaacgttttccagttcctgaagctgtactcgtcctggggcgacatgagcgagctcatcatcaacggatactttaccgtgctgtactttaacctcgtcctccgaacctcctttctcgtgatcaatcgacggaaatttgagacattttttgaaggcgttgccgccgagtacgctctcctcgagaaaaatgacgacatccgacccgtgctggagcggtacacacggcggggacgcatgctatcgatatcgaatctgtggctcggcgccttcattagtgcctgctttgtgacctatcctctgtttgtgcccgggcgcggcctaccgtacggcgtcacgataccgggcgtggacgtgctggccaccccgacctaccaggtcgtgtttgtgctgcaggtttaccttaccttccccgcctgctgcatgtacatcccgttcaccagcttctacgcgacctgcacgctgtttgcgctcgtccagatagcggccctaaagcaacggctcggacgcttggggcgccacagcggcacgatggcttcgaccggacacagcgccggcacactgttcgccgagctgaaggagtgtctaaagtatcacaaacaaatcatccaatatgttcatgatctcaactcactcgtcacccatctgtgtctgctggagttcctgtcgttcgggatgatgctgtgcgcactgctgtttctgctaagcattagcaatcagctggcacagatgataatgattggatcgtacatcttcatgatactctcgcagatgtttgccttctattggcatgcgaacgaggtactggagcagagcctaggcattggcgatgccatttacaatggagcgtggccggactttgaggaaccgataaggaaacggttgattctaattattgcacgtgctcagcgaccgatggtgattaaagtcggcaacgtgtacccgatgacgttggaaatgtttcaaaaattgctcaacgtgtcctactcctatttcacactgctgcgccgagtgtacaactaa

SEQ ID NO: 5 - protein, 408 aa, Anopheles gambiae
MPSERLRLITSFGTPQDKRTMVLPKLKDETAVMPFLLQIQTIAGLWGDRSQRYRFYLIFSYFCAMVVLPKVLFGYPDLEVAVRGTAELMFESNAFFGMLMFSFQRDNYERLVHQLQDLAALVLQDLPTELGEYLISVNRRVDRFSKIYCCCHFSMATFFWFMPVWTTYSAYFAVRNSTEPVEHVLHLEEELYFLNIRTSMAHYTFYVAIMWPTIYTLGFTGGTKLLTIFSNVKYCSAMLKLVALRIHCLARVAQDRAEKELNEIISMHQRVLNCVFLLETTFRWVFFVQFIQCTMIWCSLILYIAVTGFSSTVANVCVQIILVTVETYGYGYFGTDLTTESYGVALAIYDSEWYKFSISMRRKLRLLLQRSQKPLGVTAGKFRFVNVAQFGKMLKMSYSFYVVLKEQF

SEQ ID NO: 6 - DNA, 1227 bp, Anopheles gambiae
atgccttctgagcggcttcgtctcattacttcctacggaactcctcaagacaaacgcacgatggtactgccaaaattaaaggatgaaacagcagtgatgccgtttctgctacgaattcaaaccattgccggactgtggggtgaccgttcccagcggtaccgtttttatctcatcttttcctacttctgcgcgatggtggttctacccaaagtgctgttcggttatccagatctcgagattgcggtacgcggcacggccgagctgatgttcgaatcgaacgcattcttcggcatgctaatgttttcctttcaacgcgacaactacgagcgattggtgcatcagctgcaggatctggcagctctagtcctccaagacctacccgcagagctgggagagtacctgatctcagtgaaccgacgggtcgatcggttctccaaaatttactgctgctgtcacttttccatggcaacgttcttttggttcatgcccgtctggacgacctattccgcatactttgctgtgcgcaacagcacggaaccggtagaacacgtgctgcacctcgaggaagagctgtacttcctgcacatccggacttcgatggcgcactatacgttttatgtggccattatgtggcccacgatctatacgctcggatttaccggtggcacaaagctgctgaccattttcagcaatgttaagtactgttcggccatgctgaagctcgttgcactccgaatccactgtttagcggaagtaagacaagaccgagcggagaaggagctgaacgagatcatttccatgcatcagcgggtactcgactgcgtgttcctgctggagacgacattccgctgggtatttttcgtgcagttcattcagtgtacaatgatctggtgcagtctcatactctacatcgcggtgacgggtttcagctcgacggtggcgaatgtctgtgtccagatcattttggtgacggtggaaacttacggctactgctacttcggaacagatctaaccacggagagctatagcgttgccctcgccatttacgatagcgagtggtacaagttttccatttcgatgcgccgcaaacttcgcctgctactgcaacgatcccaaaaaccgctcggcgtaacggcgggcaagtttcgcttcgtcaatgtggcccagtttggcaagatgctcaagatgtcctattcattttacgtagtactgaaggagcaattttag

SEQ ID NO: 7 - protein, 397 aa, Anopheles gambiae
MKFELFQKYSSPDTVLSFVLRLLHIVGMNGAGFRSRIRVGGIFLFYLIFLVIPPLTGGYTDGHQRVRTSVEFLFNCNIYGGSMFFAYDVATFQAFIQELKSLSVLVCSHSYRLKYKLTRFNRRADIIAKVQTTCMGAVTLFYWIAPIPSICAHYYRSTNSTEPVRFVQHLEVKFYWLENRTSVEDYITFVLIMLPVVVMCGYVCNLKVMTICCSIGHCTLYTRMTIEMVEQLESMASAERTASAIRNVGQMHSGLLKCIRLLNTSIRSMLMLQWLTCVLNWSISLIYLTNVGISLQSVTVVVMFFLATAETFLYCLLGTRLATQQQLLEHALYATRWYNYPIAFRSSIRMMLRQSQRHAHITVGKFFRVNLEEFSRIVNLSYSAYVVLKDVIKMDVQ

SEQ ID NO: 8 - DNA, 1194 bp, Anopheles gambiae
atgaagtttgaactgtttcaaaaatattcctccccggacactgtcttatccttcgtgctaaggcttttgcatatcgtgggcatgaatggggcaggattttggtcgcgaattcgagttggtggcatttttctgttctatctaatctttcttgtgataccgccactaacgggcgggtacaccgatggtcaccagcgtgtacgcgccagtgtggaattcctgtttaattgcaacatttacggcggcagtatgttctttgcctacgatgtggccaccttccaagcgttcatccaggaactgaagagcctttcgattttggtatgctcacactcgtacagactaaagtataagctgacccggttcaaccgtcgagcggatattatctccaaagtgcaaacgacctgcatgggtgctgtaacacttttctactggattgcaccgataccttccatctgtgcgcactactacaggtcgaccaattccaccgaacccgtgcggtttgtgcaacatttggaggtgaagttctatcggctcgagaatcgcacctcagtcgaggactacataaccttcgtgctgatcatgctacccgtcgtggttatgtgtggttacgtatgcaatttgaaggtgatgaccatctgctgcagcattggacactgtacactgtacaccaggctgactatggagatggtagagcagttggaaagcatggcatcagcggaacgaactgccagcgcaatacgcaacgtggtgcagatgcacactggtttactgaaatgcatccggcttttgaacacgtcgattcgatcgatgctgatgctgcagtggttgacctgcgtgttaaactggagcatttctctcatctatctaacgaacgtgggcatctcgctacaatcggttaccgtggtggtaatgttttttcttgccactgcggaaactttcctgtattgtttactcgggacgcagcttgcgacacagcagcagctgctagagcatgcactctatgctacacgttggtacaactacccaatagcctttcgcagcagcattaggatgatgttgagacagtcgcaaaggcatgcacacataacggtggggaagttttttcgcgttaatttggaagaatttagcaggattgtcaacttatcctactctgcttacgtcgtacttaaggatgtaataaagatggatgtacagtga

SEQ ID NO: 9 - protein, 389 aa, Anopheles gambiae
MVLPKLSEPYAVMPLLLRLQRFVGLWGERRYRYKFRLAFLSFCLLVVIPKVAFGYPDLETMVRGTAELIFEWNVLFGMLLFSLKLDDYDDLVYRYKDISKIAFRKDVPSQMGDYLVRINHRIDRFSKIYCCSHLCLAIFYWVAPSSSTYLAYLGARNRSVPVEHVLHLEEELYWFHTRVSLVDYSIFTAIMLPTIFMLAYFGGLKLLTIFSNVKYCSAMLRLVAMRIQFMDRLDEREAEKELIEIIVMHQKALKCVELLEIIFRWVFLGQFIQCVMIWCSLVLYVAVTGLSTKAANVGVLFILLTVETYGFCYFGSDLTSESLSVARAAYGSLWYRRSVSIQRKLRMVLQRAQKPVGISAGKFCFVDIEQFGNMAKTSYSFYIVLKDQF

SEQ ID NO: 10 - DNA, 1170 bp, Anopheles gambiae
atggtgctaccgaagctgtccgaaccgtacgccgtgatgcctcttctactacgcctgcagcgtttcgttgggctgtggggtgaacgacgctatcgctacaagttccggttggcatttttaagcttctgtctgctagtagttattccgaaggttgccttcggctatccagatttagagacaatggttcgcggaacagctgagctgattttcgaatggaacgtactgtttgggatgttgctgttttctctcaagctagacgactatgatgatctggtgtaccggtacaaggacatatcaaagattgctttccgtaaggacgttccctcgcagatgggcgactatctggtacgcatcaatcatcgtatcgatcggttttccaagatctactgctgcagccatctgtgtttggccatcttctactgggtggcgccttcgtccagcacctacctagcgtacctgggagcacggaacagatccgtcccggtcgagcatgtgctacatctggaagaggagctgtactggtttcacacccgcgtctcgctggtagattactccatattcaccgccatcatgctgcctacaatctttatgttagcgtacttcggtggactaaagctgctaaccatcttcagcaacgtcaagtactgttcggcaatgctcaggcttgtggcgatgagaatccagttcatggaccggctggacgagcgcgaagcggaaaaggaactgatcgaaatcatcgtcatgcatcagaaggcgctaaaatgtgtggagctgttggaaatcatctttcggtgggtttttctaggacagttcatacagtgcgtaatgatctggtgcagcttggttctgtacgtcgccgttacgggtctcagcacaaaagcagcaaacgtgggtgtactgtttatactgctaacagtggaaacctacggattctgctactttggcagtgatcttacatcggagagcttgagcgtagcacgtgcagcgtacggtagcctctggtatcgccgttcggtttcgatccaacggaagcttcgaatggtactgcagcgtgcccagaaaccggtcggcatctcggctggcaagttttgcttcgtcgacattgagcagtttggcaatatggcaaaaacatcctactcgttctacatcgtactgaaggatcaattttaa

SEQ ID NO: 11 - protein, 405 aa, Anopheles gambiae
MVRLSFEETLRNTNLMLLMMGIPPCEEPYPPGVLPSLKRNAGFIASFLLLAYTTIGELIYLKQMFERDVTFLEVTFQAPCIGYCTIGVLKMVILARGRNTIAELVGLFRAKWTSAIVTGAHWAVCEDTMRPAIRVTSVTALANVVMGIAFTILPIAEMIYTHHYTGRWNRQLAFNIWWPFDVLGGVKYYWFVYPLYVVIGFTGIIIHMAFDCLFCILAAHLCMQFRILAHNFGHVVEVANGAREGDSGSTSRLRDAIRIHQELIGYEGTPLDAGVNQWRNGYMLVKFVLFMLCFLIELLMLCAYGEDIVESVRHQAVMSESRVIEAFAFKTHQSLGVIDAAYGCEWYREGSVAFHRSVLQIIHRSQQSVILTAWKIWPIQMSTFSQILQASWSYFTLLKTVYGNK

SEQ ID NO: 12 - DNA, 1218 bp, Anopheles gambiae
atggtacgtctaagctttgaagaaacgcttcgaaacaccaacctgatgctactgatgatgggcattccaccgtgcgaggagccgtacccgccgggcgtactgccgtcgctcaaacgcaacgcgggcttcatcgcgtccttcctgctgctcgcctacaccacgatcggtgagctgatctatctgaagcagatgttcgagcgggacgttaccttcctggaggtaacctttcaagcgccctgcatcgggtactgcaccatcggtgtgctgaagatggtcatactggcccggggaaggaacacgatcgccgagctggtcggtttgtttcgcgcaaagtggacgtcggcgattgtaaccggtgcgcattgggcggtgtgcgaggacacaatgcggcccgccattcgggtcacctcggtaacggcgctcgcgaacgtcgtgatggggatagcgttcaccatcctgccgatcgcggagatgatctacacccatcactacacgggccggtggaaccgtcagcttgccttcaacatctggtggccgttcgatgtgctgggtggcgtaaagtactactggttcgtctatccactgtacgtcgtgattgggttcacgggcatcatcatccatatggcgttcgactgtttgttctgcatactggcggcccatctctgtatgcagtttcgcatcctggcgcacaactttggccatgtggtagaggttgccaatggtgctcgtgaaggtgacagtggcagtacgagtcggctacgggatgcgatcagaatccatcaggagttgattgggtacgaaggaaccccattggatgcgggagtaaatcaatggcgtaacggatatatgctggtaaagtttgtcctcttcatgctgtgctttctgatcgagctgctgatgctgtgtgcgtacggtgaggatattgtggaatcggtaaggcaccaggcggtgatgagcgagtcgcgagtaattgaagcttttgcttttaaaacacatcagagccttggggtgattgatgccgcttacggttgcgaatggtaccgggaagggtcggtggcgttccatcgatccgtgctgcaaattatacaccgcagccagcagtccgtcatactgaccgcatggaaaatttggcccatccaaatgagtactttcagtcagatcctgcaagcttcctggtcctactttaccctcctgaagaccgtctacgggaataagtaa

SEQ ID NO: 13 - protein, 478 aa, Anopheles gambiae
MQVQPTKYVGLVADLMPNIRLMQASGHFLFRYVTGPILIRKVYSWWTLAMVLIQFFAILGNLATNADDVNELTANTITTLFFTHSVTKFIYFAVNSENFYRTLAIWNQTNTHPLFAESDARYHSIALAKMRKLLVLVMATTVLSVVAWVTITFFGESVKTVLDKATNETYTVDIPRLPIKSWYPWNAMSGPAYIFSFIYQIYFLLFSMVQSNLADVMFCSWLLLACEQLQHLKGIMRSLMELSASLDTYRPNSSQLFRAISAGSKSELIINEEKDPDVKDFDLSGIYSSKADWGAQFRAPSTLQTFDENGRNGNPNGLTRKQEMMVRSAIKYWVERHKHVVRLVSAIGDTYGPALLLHMLTSTIKLTLLAYQATKIDGVNVYGLTVIGYLCYALAQVFLFCIFGNRLIEESSSVMKAAYSCHWYDGSEEAKTFVQIVCQQCQKAMTISGAKFFTVSLDLFASVLGAVVTYFMVLVQLK

SEQ ID NO: 14 - DNA, 1437 bp, Anopheles gambiae
atgcaagtccagccgaccaagtacgtcggcctcgttgccgacctgatgccgaacattcggctgatgcaggccagcggtcactttctgttccgctacgtcaccggcccgatactgatccgcaaggtgtactcctggtggacgctcgccatggtgctgatccagttcttcgccatcctcggcaacctggcgacgaacgcggacgacgtgaacgagctgaccgccaacacgatcacgaccctgttcttcacgcactcggtcaccaagttcatctactttgcggtcaactcggagaacttctaccggacgctcgccatctggaaccagaccaacacgcacccgctgtttgccgaatcggacgcccggtaccattcgattgcgctcgccaagatgcggaagctgctggtgctggtgatggccaccaccgtcctgtcggttgtcgcctgggttacgataacatttttcggcgagagcgtcaagactgtgctcgataaggcaaccaacgagacgtacacggtggatataccccggctgcccatcaagtcctggtatccgtggaatgcaatgagcggaccggcgtacattttctctttcatctaccagatttacttcctgctgttttcgatggtccagagcaacctcgcggatgtcatgttctgctcctggttgctgctagcctgcgagcagctgcaacacttgaagggtattatgcgatcgttgatggagctttcggcctcgctggacacctaccggcccaactcttcgcaactgttccgagcaatttcagccggttccaaatcggagctgatcatcaacgaagaaaaggatccggacgttaaggactttgatctgagcggcatctacagctcgaaggcggactggggcgcccagttccgtgcgccgtcgacgctgcaaacgttcgacgagaatggcaggaacggaaatccgaacgggcttacccggaagcaggaaatgatggtgcgcagcgccatcaagtactgggtcgagcggcacaagcacgttgtacgtctcgtttcagcaatcggagatacgtacggtcctgccctgctgctacacatgctgacctccaccatcaagctgacgctgctcgcctaccaggcaacgaaaatcgacggtgtcaacgtgtacggattgaccgtaatcggatatttgtgctacgcgttggctcaggttttcctgttttgcatctttggcaatcggctcatcgaggagagctcatccgtgatgaaggcggcctattcctgccactggtacgacgggtccgaggaggcaaaaaccttcgtccagatcgtttgtcagcagtgccagaaggcgatgactatttccggagccaagtttttcaccgtttcgctcgatctgtttgcttcggttcttggagccgttgtcacctacttcatggtgctggtgcagctgaagtaa

SEQ ID NO: 15 - protein, 399 aa, Anopheles gambiae
MDPPTDELVRFESFIRVPEIFFAMIGVARYGEPKRTLRAYLKHLLFWSSCINTGFCLVIEHIYFVKAAGNFTNFLQLTALAPCMGFTALSFVKIMTIKLTETKLTDMLHRLDALFPSTVALQQRYGVYQYNRESQVVMKSFSILYMILIWMFNLLPLVSMVAGYVSDGTWHKQLPYFMWYWYDWHRPGYFAVTFLHQNWGGFVSAVFYLSTDLMFCAIVLLLCLQFDIVAYRLSHALPDDHQELVGCVRIHQAVIELCNELEHMFSPSLLVNFLSSSVIICLVGFQATAGITPADLFKFVLFLVSPLVQVFLLCYYGNKLIVASSQIPYSAFEGNWIGASVSYQRSLLFVMLRSTTVQKLTALKFSIVSLASYSKILSTSFSYFTLLKAMYEPNEKKMK

SEQ ID NO: 16 - DNA, 1200 bp, Anopheles gambiae
atggacccaccaacagacgagctggtgcgtttcgagtcgtttatccgtgtgccggaaattttcttcgccatgatcggtgtggcacggtacggtgagccgaagcgaacgcttcgggcgtacctaaagcatctgctcttctggtcgtcgtgcatcaataccggcttctgtctcgtgatcgagcatatctacttcgtgaaggcggccggtaactttaccaactttctgcagctgaccgcactggcaccgtgcatgggctttaccgcgctgtcgttcgtgaagatcatgacgatcaagctgaccgagacgaagctgaccgatatgctgcaccggctggatgcgctcttcccgagcacggtcgcactgcagcagcggtacggtgtgtaccagtacaaccgtgaatcgcaggtcgtgatgaaatcgttctcgatcctgtacatgatcctgatctggatgtttaacctgctgccgctggtgtcgatggtggcgggatacgttagcgacggcacgtggcacaagcagctgccgtactttatgtggtactggtacgattggcaccggcccggctacttcgcggtgacgtttctgcaccagaactggggcgggttcgtttcggccgtgttctacctctcgaccgatctgatgttctgtgcgatcgtgctgctgctctgtctgcagtttgacatcgtggcctaccggttgagccacgcgctgcccgatgaccaccaggagctggtcgggtgtgtgcgcatccatcaggcggtgatcgagctgtgcaatgagctggagcacatgttttccccctcgctgctggtcaactttctcagcagctccgtcatcatctgtttggtcgggtttcaggcgacggctgggattacgccggcggatctgttcaagtttgtgctgtttctcgtctcccccctggtgcaggtctttctgctgtgttactatggtaacaagctcatcgttgcgagctcgcaaattccctacagcgctttcgaggggaactggatcggggcgtccgtttcttaccagcgatcgctgctgttcgtgatgttacgctccaccaccgtgcagaagctgactgcgctgaaattctccatcgtttctctggcgagctattcgaagatactaagcacctcgttctcgtactttacgctactgaaagctatgtacgaacctaatgagaagaaaatgaagtga

SEQ ID NO: 17 - protein, 393 aa, Anopheles gambiae
MFLPSLRMILFIFRMFYAWPDEHLEKSALWWYRAKGVLFRVFFIYLSAATQLAYNFTVTSREELFAGMFVLLTQLVMILKMEFFYKNVFKIQQLIRRLNGKLYQSRNAEEDIPLASARKKSTIFWVLYFMFSDGLVTEWLVISLLLTTLIVPVWPRVDHTTPYWVVLMVILYQYMAIVLNASFNISWDSLVAALLALTNAHLHRLQIQLLKVDANKRMITVSPIDDDARSVPPKSDADVVYNELLQCIIFHQEVTGFLREVLTLFSGPMLSQLYCSVFILCITEFRLLTDVNTMADTMQAVMYLVCLVIQVVQYCYFGNEINYMAQKVHQATAFVNYPDMNIKTRKLLIAFQQITARGIKCSAKYIFTIELSMQTFIIKTSYSYLAVLRSMTD

SEQ ID NO: 18 - DNA, 1182 bp, Anopheles gambiae
atgtttctaccatcgttgcgtatgattttgttcatttttcgaatgttttacgcgtggccggacgagcatttggagaaaagtgctctctggtggtaccgtgcaaagggtgtgctgtttcgtgtgtttttcatatatctttcagcagccacacagctagcttacaacttcactgtgactagtcgtgaggaactgtttgctggaatgtttgtgctgctcactcagcttgtgatgatactgaagatggagtttttctacaaaaatgtgttcaaaattcaacagctcatccgtagactgaatggcaagctctaccagtcgagaaatgcggaggaagacattccgctggcgagtgcgcgtaagaagtcaactatattctgggtcttgtacttcatgttttccgatgggctggttacggagtggttagtgatatcgttgttgctcactactttgatagtaccggtgtggcccagagtagatcataccaccccgtattgggtagttttaatggttatcttgtatcagtacatggcaatcgttctcaacgcttcgtttaacatatcatgggactcactggtggcagcactgttggcgttaactaacgcccatcttcatcgactgcaaatacagctattgaaggtggatgctaataagcgtatgattacggtctctccaatcgatgatgatgctcggagcgtcccaccgaaatcagatgcagatgtagtttacaatgaactactacaatgtattatctttcatcaggaagtaactggatttcttcgcgaagtgctgaccctgttcagtggaccgatgctttctcagctgtactgttccgtgttcatcctgtgtattaccgagtttcgtttgctcacagacgtgaacacaatggccgacacgatgcaggcggtaatgtacttggtgtgccttgtcatacaagtggtgcaatactgttactttggcaatgaaattaactatatggctcaaaaggtacatcaagcgaccgcctttgtgaactacccggatatgaacatcaaaactagaaagcttcttatagcttttcaacaaataaccgctcgaggaataaagtgcagtgcgaagtacatttttacaatcgaactgagcatgcagacctttatcatcaaaacatcctactcgtatttggcagttttgagatcgatgacggattag

SEQ ID NO: 19 - protein, 375 aa, Anopheles gambiae
MEVLNCPLLSVNVRVWRFWSFVLVHNWRRYISIIPVTALNVFMFADLYRAWGNIEEVIINAYFAVLYFNAVLRTLILVYNRDKYESFLAGAASVYEEIRAINDDVITKLVSTYTKRARFLSISNLALGAFISGCFVVYPLFTGQRGLPYGMFIPGVNNFDSPQYEIFYITQLVLTFPGCCMYIPYTSFFASSTLFGLVQIKTLQHQLKTFRSSEMLNESTVVLNRKLQKLIEDHKRIIRYVQDLNDLVTYICLIEFLSFGLMLCALLFLLNIISVMAQIVIVGAYIFMILTQIFAFYWHSNEVREESMAIAQASYSGPWLNVDDTIKKKLLMMTIRAQRPLEITVGNVYPMTLEMFQSLLNASYSYFTLLRRVYN

SEQ ID NO: 20 - DNA, 1128 bp, Anopheles gambiae
atggaggtcctcaactgtccgctactgtcggtgaatgtgcgcgtgtggcgcttctggtcattcgtgctggtgcacaactggcgacggtacatcagcatcatcccggtgacggcgctgaacgtgttcatgtttgccgacctgtaccgggcctggggcaacatcgaggaggtcattattaatgcttattttgcggtgctctatttcaacgcggtgctgcgcacgctgatactggtgtacaatcgggacaagtacgagtcattcctggccggtgcggccagcgtgtacgaggaaatacgagctatcaacgatgacgtcatcacgaaactcgtctcaacgtacactaaaagggctcgcttcctgtccatctccaacctggcgctcggtgcgttcatcagtgggtgtttcgttgtgtacccactgtttaccgggcagcggggcctaccgtacgggatgttcataccgggcgtgaacaatttcgactcaccgcagtacgaaatcttctacatcacccagctggtgctgacgttccccgggtgctgtatgtacattccgtacacgagcttcttcgcctcgagcaccctgttcgggctggtgcagatcaaaacgttgcagcatcagctgaaaaccttccgcagctcggaaatgctcaacgaaagcacggtggtgctcaaccgaaagcttcagaagctgatcgaagatcacaagcgaatcattcgctatgtgcaagatcttaacgatctggtgacctacatctgcctgatagagttcctgtcgttcggattaatgttgtgcgcgctgctgttcttacttaatattatcagtgtgatggctcagatcgttatcgttggagcgtacattttcatgatcctcacacaaatatttgccttctactggcactcgaacgaggtgcgggaggaaagcatggccatcgcacaggcctcgtacagcggaccgtggctgaatgtggatgacactattaaaaagaagcttctcatgatgacgatccgtgcccagcgtccactagagatcacagttggtaacgtgtatccgatgacgctggaaatgtttcaatcactgctgaatgcgtcctactcgtactttacgcttctgagaagagtttacaattaa

SEQ ID NO: 21 - protein, 423 aa, Anopheles gambiae
MELKEEWILPDVVYANPLLKRTLLGLRYYGILLGQSQSYKKVHCFRGMVFTLSMVLFNCTQYIDLWQVWGSVSDMTANAATTLLFSTTIFRIIFFYFHRARFTSIIKAAHDGIERILKDGWTDEQSIVGSNVRYLKRLAVVFWSCALVTANMMCVYSLVQYLTYEEGPPDGTGTSAANITRKGQPIPPTPILRSWYPTADGKDKHFLEIYLIQLYIMYVGQLIVPSWHMFMVTLMIYGRTECSVLNHRLCFLERYHTAGKDDPTAPVNNAERRSLMIDCIKRQASLVSFTRELEQLTRAAVFLDFVVFSVLLCALLFEASMTPSGVQVFIDVCYITTMTTILFLYYWHANEIHACADRLSMSAYKSDWYRYDRGTNRMLQIFILYSNRPLKMHAFFISMSLDTFLAILRASYSYFTILKQLTD

SEQ ID NO: 22 - DNA, 1272 bp, Anopheles gambiae
atggagctgaaggaagaatggatccttccggacgtggtgtacgcaaatccgctgctaaagcgtaccctgctcggcctaaggtactacggcatactgctcggtcagtcacaaagctacaagaaagtgcactgcttccggggcatggtgtttacgctgtcgatggtgctgtttaactgcacgcagtacatcgatctgtggcaggtatggggctccgtttcggacatgacggcgaacgcggccaccacgctactgttcagcacgaccatctttcgcatcatcttcttctactttcatcgggcgcgatttaacagcatcattaaagccgctcacgacggtatcgagcggatcttgaaggacggttggaccgatgagcagagcattgtgggcagcaatgtgcgctatctgaagcggcttgccgttgtcttctggagctgcgccctagtgacggccaacatgatgtgcgtgtattctttggtgcaatatttaacgtacgaagaaggaccgcccgatggcactgggacgagtgctgcgaacatcacgcgcaaagggcaaccgattccaccgacgccaattctacgctcctggtatccaacggccgatgggaaggataagcactttctcgagatttacctcatccagctgtacatcatgtatgtcggccagctgatcgtcccgtcctggcacatgtttatggtcacgctgatgatctacggccgcaccgagtgtagtgtgctgaaccatcggctctgctttctggaacgctaccacacggctggaaaggacgatcctaccgccccggtaaacaacgctgaacgccgatcgcttatgatcgattgcatcaaacggcaggcaagcttggtatcgttcaccagggagctggagcagctaacgcgtgccgccgtgttccttgactttgtcgtgttttccgtcctgctctgtgcgctactgttcgaagcatcgatgacgccgtccggggtgcaggtgtttatcgacgtctgctacattaccacgatgacgacgattctgttcctttactattggcacgcgaacgagatacatgcgtgcgccgaccggctttcaatgtcggcgtacaaaagtgactggtatcggtacgatcggggcacgaaccggatgctacagatctttatcctgtacagcaatcggccgcttaaaatgcacgcattctttatctcgatgtcgctggacacgtttttagcgattctgcgcgcgtcgtacagttatttcacaattttgaaacaattaaccgactaa

SEQ ID NO: 23 - protein, 398 aa, Anopheles gambiae
MEKLRPEDPKAVMPYAKRLLQLSGFRQDTEQLGTRIYLNLFIFVAAILIPKVCFPYPDTEAMVRGLSELIFFTNIFVGLFCFIAQHRPYRELLNAIESFVNIVYRTSSQQPESLSERTLIKLNVKINQISVVYCYYVAVAAFTYWIAPCLITYLSIHKEQDIAGNGTMNAIQYYPNLEESFYWLDNRTSVRGYAVLSVVAFITFIFAVYSQTTKLLTILSTIKYCSTLLQLVNIAIEGLSSISPENIDLELKKLIQMHQLAIRCVALLNQTLSYVFALQLVLCMLTWCFTLLYVLVVRLDVTSMMSLLIMINLTPEMFGYCFFCSDLTTTGTTISRQMYEFQWERHRPAIQKTVAMVIARGQARLRITAWGIIPIDLELFAKVVKASYTVLLVLKDFI

SEQ ID NO: 24 - DNA, 1197 bp, Anopheles gambiae
atggaaaagctacgtccagaagatccgaaggcagttatgccttacgcaaagcgacttcttcagctgtctggtttcagacaggatacggaacagcttggaacaagaatttacttgaatcttttcatcttcgttgcagcaattttgataccgaaagtgtgctttccctacccggatactgaagccatggttcgaggcttaagtgagctgatctttttcaccaacatatttgttggccttttctgcttcattgctcagcatcgcccctacagagaactactaaatgcgatcgaatccttcgtaaatattgtgtaccgtacatcatcacaacaacccgaatcactatcagaacgaaccttgatcaaactaaacgttaagataaatcaaatttccgttgtctactgctattacgtagcagtggcagccttcacgtactggattgcaccatgcttgataacatacctttcgattcacaaagaacaagacatcgcaggaaatggaacgatgaatgcgatccaatactacccgaacctcgaggaatcgttttactggcttgacaatcgtacttctgtgaggggttatgccgtgttgagtgtagtggcattcataacatttatatttgccgtatatagtcaaactacaaagctactaacgatcctgtccacgatcaagtactgcagcacactgcttcagctcgtcaacatcgctattgaaggattgagcagtataagtccagaaaacattgatctagagctcaaaaaactcatccaaatgcatcagctggcaattcgctgtgtcgcactgctcaatcaaacgttaagctatgtattcgctcttcagctggtgttgtgcatgttgacctggtgcttcacgcttctatacgtcctagtcgtcagactcgatgtgacatcgatgatgagcttgctgataatgatcaatttgacgcccgaaatgtttgggtactgctttttctgcagcgatcttactaccaccggtacaaccattagccggcagatgtacgagttccaatgggaacgacatcgtcctgcgatacagaaaacggttgcaatggttattgcccgtggccaagcacggctacggattacagcgtggggcattattccaatcgatctcgaattgtttgctaaggttgtcaaggcatcttacaccgttcttctcgtgctaaaggatttcatctag

SEQ ID NO: 25 - protein, 388 aa, Anopheles gambiae
MNFLRQEQPAGMPHISIKLLQLFGVTGSPEERFRILPVMLTYFFFIVVPKCFFGYPDLEITIIGTAELIFQSNTFCGMFWLFLNRHKLAQFITQVRTFSLTVFRESPPAVVQHLTTQHDFIHKITRIYCIVVMFAAHFYVLTPLLSTFYAFYGTVRNDNVTVHYTLQMEENFYGLQTRTTTSHYLIFGMFMTPTIYLCAFTGTVKILSICNITMYCTLYFQLVQLKLRTATEDNTFNRQEVKSIVVMHQDALNCASLVESITSLVLLQQLVLCVMIWSSMLLYFTVSGFDLNFINLLVLFAFDTTETIAYCYFGEQLSNESARVAHTVYESGWETQTPDIQKDLQLIIARAQRPVGITAGKFCYMNMEQLGIIVKTTYSIYIILRDQF

SEQ ID NO: 26 - DNA, 1167 bp, Anopheles gambiae
atgaatttcctccgacaggagcaaccggctggcatgcctcatatctccatcaaactgcttcaactgtttggcgttaccggctctccagaggaacgctttcgtatcctgccggttatgctgacctactttttcttcatagtagtgcccaagtgcttcttcggatatcccgaccttgagataacaatcattggcactgctgagctgattttccaatccaatactttttgtggaatgttttggttgtttctgaacagacacaagctagcacagttcattacacaagtacgaactttttctctaacggttttccgagagtcacctccagcggtggtccagcatttaacgacccagcacgactttatccacaagataacccgaatctattgcatcgtagtgatgtttgcagcccacttctacgtgctaactccattgctttcaacattctacgcgttctacggtacggtacggaacgataacgtaaccgtgcactacacgctgcaaatggaggaaaacttctacggactacagactcgcacgacgacttcgcactacctgatcttcggcatgttcatgacgcccaccatttatctctgtgccttcaccggtacggtaaagatcctgagcatctgtaacattaccatgtattgtaccctttactttcaactggtacaactgaagctacgaaccgcaacggaggacaacacgttcaaccgtcaggaggtgaagtcgattgtcgtaatgcatcaggatgcgcttaactgtgcaagcctggtagaatctatcacgtcactagtgctattacagcaactggtcctatgcgtaatgatctggagctcaatgctgctttacttcaccgtatcgggtttcgatttgaactttattaaccttctcgtccttttcgcttttgatacaacagaaaccattgcttactgctattttggagagcagctatcgaacgagagtgctcgtgtggcacataccgtttacgaaagtggatgggaaactcaaactcccgacatacagaaagatcttcagctaattatcgcgcgcgcacaaaggccggttggcatcactgctggcaagttttgctacatgaacatggaacaacttggcattatagtgaaaactacctactctatctacatcatattaagagatcagttttaa

SEQ ID NO: 27 - protein, 409 aa, Anopheles gambiae
MLFQELPNDRAVLPLLLYIQERLGFWGDRTTRVRYPVAFVAFWITVAIPKLATDYSDVELFICSMAELAFVGNVFCGGMALWSVYNSFRQFIEQVIRLTKYLYRDHHPLQTVREQLLQFNHRIHRYTNRYCFSMMILIVFYLVAPVITSFGVYFQSVWQSHHDTNDTIRIWEISQVAPHRQFSLHMEQDFYGLQHRTNILHYTLYIAVIVPMMFVTACTVHMKVLTIASSVRYAEMLLHVVMLKVDNLHRIPNQKSIREELHDIIHVHQRTLNCITLLVQALRPILMVQLVFCVFIWCLMMLFFTIADKFSVAFFNLAILFVVITIETFSACYFGTRLSTQAVELSKSVYGCGWPAMDRDIQQGLRMVLHRTQSPVGIQAGKFCFVDVELFQNMVNKSYSFFIVLKDAF

SEQ ID NO: 28 - DNA, 1230 bp, Anopheles gambiae
atgcttttccaagagttgccgaacgatcgtgccgtcctgccgctgcttctgtacattcaggagcggcttgggttttggggagatcgtaccacccgggtacgctatccggtcgctttcgtggcgttctggattaccgtggccataccgaaacttgcgacagactacagtgatgtggaattgttcatctgctcgatggcggagcttgctttcgtgggaaacgttttctgcggtgggatggcgctctggtcggtgtacaattccttcagacaattcatcgagcaagtcatcaggttgacgaaatatttgtatagagaccatcatccgctacagactgtacgggagcaactgttgcagtttaaccatcgaatccatcgctacaccaacagatactgtttctcgatgatgattttaattgtattctaccttgtggcaccagtaataaccagcttcggggtgtactttcaatccgtatggcaatctcaccatgatacaaatgacactatccgtatctgggaaatttctcaagtggcaccacatcggcaattttcccttcacatggagcaagatttctacggactccagcatcggaccaacattcttcactacacactctacatcgcagtcatagtgccgatgatgttcgtaacggcctgtaccgtgcatatgaaggtgctaactattgcatcttctgttcggtacgctgaaatgctgctccacgttgtgatgctcaaggttgacaacttgcaccgaatacccaaccagaagtccatccgtgaagaactgcatgacataatccatgtacatcaacggacgctcaactgcatcaccctgctcgtgcaggctctacggcccatcctaatggttcagctcgtgttttgtgtctttatctggtgtttgatgatgcttttctttaccattgcagataagttcagtgttgcgtttttcaatcttgcgatactgttcgtcgtcatcacgatcgaaacgtttagcgcgtgttattttggaacgcgcctctctacccaggcagttgagctctcgaaaagcgtgtacggttgcggatggccagcgatggaccgtgacatccagcagggactgcgcatggtgctgcatcgcacgcaatcgccggtcggcatacaggcgggcaagttttgtttcgtcgatgtggagctgtttcagaatatggttaataagtcctactcgttctttattgtgctgaaggatgccttctag

SEQ ID NO: 29 - protein, 387 aa, Anopheles gambiae
MNFLRQEQPAGMPHISIKLLRVFGVTNHSEERFRIVPVMLAYFFFIVVPKCFFGYPDLEIMIIGTAELIFQTNSFCGMFLLFLNRRKLAEFIQHARSFSQTVICASPPAVVRHLTTQHDMIHKITRIFCIVVMFAAHFYALAPFLSTLYTFYGTVRNKNATMHYTLQMEENFYGLQTRTSATHYLIFGIVMTPTAYLCAFTGTVKTLTICNITTYCTLYFQLVQLKLRTVTQDNTFRQELKSVIKMHQDALNCASLVESITSLALLQQLLLCVLIWSSMLLYFTVSGFNVNFMNLFVLFVFDTTETFAYCYLGEKLSYESARVAHTIYESGWETQTTDIQKDLQLILVRAQSPVGITAGKFYYMNMEQFGIIVKTTYSFFVILRDQI

SEQ ID NO: 30 - DNA, 1164 bp, Anopheles gambiae
atgaacttcctaagacaggagcaaccggctggcatgcctcatatctccatcaagctgctccgggtatttggcgttaccaaccattcagaggaacgctttcgtatcgtgccggttatgctggcctactttttcttcatagtagtgcccaagtgcttcttcggatatcccgaccttgagataatgatcattggcaccgctgagctgattttccaaaccaactccttttgcggaatgtttctgttgtttctgaacagacgcaaactggctgagttcattcaacatgctagaagtttctcccaaacggttatctgtgcgtcacctcccgcagtggtccggcatttgacgacccagcacgacatgatccacaagataaccagaatcttctgcatcgtagtgatgtttgcagctcacttctacgcattagctccttttctttctacactttacacgttttacggtacggtacggaacaaaaacgcaaccatgcactacacgctgcaaatggaggaaaacttctacggactacagactcgcacctcgggtacgcactacctgatcttcggtgtcgtcatgacgcctaccgcgtatctctgtgcctttaccggcacggtgaagactctaaccatctgtaatattactacctactgtaccctttactttcaactggtacaactgaagctacgaaccgtcacgcaagacaacacgttccgccaggagttgaagtcggtgatcaagatgcatcaggatgcacttaactgtgcaagtctggtagaatctatcacgtcactagcgctattacagcaactgcttctatgcgtattgatctggagctcaatgctgctttacttcaccgtatcgggattcaatgtgaactttatgaaccttttcgtactgttcgtgttcgacacaacggaaacctttgcctactgttatcttggggaaaagctatcgtacgagagtgctcgtgtagcacataccatttacgaaagtgggtgggaaactcaaaccaccgacatacagaaagatcttcagctaattcttgtccgtgctcaaagtccagttggcatcactgctggaaagttttactacatgaacatggaacagtttggcattatagtaaaaactacctactcgttctttgtgatattgcgggatcagatttaa

SEQ ID NO: 31 - protein, 385 aa, Anopheles gambiae
MRFFLIEKPPGVPHIALKLLRLVGVSQTQSERYRYVPMFVLFLLTIAIPKIAFGYPNFETSIIGLAELFFQTNRFVGVLLLVLYSDSIFELVRQSEFFAKKVLSETSPVAEYLTKMDTQVTKITKLYLTALLVPANFYSYSPIVATLWKYYNTYENDTVPEFTLHMEESFYRLNVREKLDHYLIFGAIMVPISFLCALVGTAKLVSILSLIKYCTIYFQLVKVKLEEVGRSQNYASDIRSAIQMHQSALSCADVLHDITAPIMLLQLVLCIMVWSSMLLYFTVAGFNTQFISLFILVMFDTTETFGYCYLGNQLSDESARVASVVYDCRWEGMPPALRKDLQLIMLRAQRSVGITAGKFCFMNMEQFGEVVKTTYSFFVVLRDQF

SEQ ID NO: 32 - DNA, 1158 bp, Anopheles gambiae
atgaggttcttcttaatcgaaaaaccgcccggtgtgccgcacattgcactgaagctcctaagactggttggagtttcacagacgcaaagcgaaagatatcgatacgtgccgatgtttgtgctatttttacttacaatagctataccgaagattgcgtttggatatcccaactttgagacatctatcatcggtttggctgagctgttctttcaaacgaatcgtttcgttggggtattattgttagtgctctatagtgattcgatttttgagcttgtgcgacagtcagaattcttcgcgaagaaagttcttagcgaaacgtctccagttgctgaatatcttaccaagatggacacccaagtcaccaaaatcactaaactgtaccttaccgcccttctggtaccggctaacttctacagctactccccaattgttgcgaccctttggaagtattacaacacatacgaaaacgacaccgtcccggagtttaccctacacatggaggaaagcttctacagactaaatgttcgggaaaagctggaccactacctgatctttggtgccatcatggtgccaatttcgtttctttgtgctctcgtcggaacagccaaacttgtgtcgattctgagcctcatcaagtactgcaccatctacttccagctggttaaggttaaactagaagaggttggccgttctcaaaattatgctagtgatataagatccgctattcaaatgcatcaaagtgcgctcagctgtgccgatgtgctacatgatatcaccgctcccatcatgctactgcagctagtgctttgtataatggtgtggagttcaatgctgctgtacttcaccgtggcgggatttaatacacagtttattagtctgtttatattgttcatgttcgacacaaccgaaacgtttggatattgctacttgggtaatcaactttctgacgagagcgctcgtgtcgccagtgttgtgtacgactgcagatgggaaggtatgcctccagctttacgcaaagacctgcagctcataatgctacgtgctcaacggtctgttggtattactgctggcaagttttgttttatgaacatggaacagtttggtgaggtcgtcaagacaacgtattcatttttcgttgtcttgagggatcaattttaa

SEQ ID NO: 33 - protein, 387 aa, Anopheles gambiae
MNFLRQEHPAGMPHISIKLLRVFGVTGGPDVRFRILPVMLTYVFCIVVPKCFYGYPNQEIAIIGIAELFFLTNSFCGMFLLFLNRHKLAEFIRHVRTFSLTVLQESPPAVVQHLTTQHDFIHKITRMYCIVVMFAAHFYVLTPFLSTLYAFYGTVRNENATMHFALQIEENFYGLQTRTTTSHYLLFGMIMTPTVYLCAFTGTVKTVTICDTTIHCILYFQLAQLKLRIVTQDNTFRQELKTVIKMHQDALNCASLLESITSLVLLLQLILCVLIWSSMLLYFTVSGFDLNFISLIILFVFDTTETFAYCYLGELLSYESARIAHIVYKNGWERQHAYVQKDLQVIIARAQKTVGITAGKFCYMNMAQLGIIVKTTYSFFVILRDQI

SEQ ID NO: 34 - DNA, 1164 bp, Anopheles gambiae
atgaacttcctccgacaggagcaaccggctggcatgcctcatatttccatcaagctgctccgagtgtttggcgttaccggcggtcccgacgtacgctttcgcatcctgccggttatgttgacctacgttttctgcatagtagtgcccaagtgcttctacggataccccaatcaggagatagccatcattggcatagccgagctgtttttcttaaccaactcgttttgtggaatgtttctgttgtttctgaacagacataagctagctgaattcattagacatgtacgaactttctctctaacggttctccaagagtcacctccagcggtggtccagcatttgacgacccagcacgacttcatccacaagataacccgaatgtattgcatcgtagtgatgtttgcagcccatttctacgtgctaactccctttctctcaaccctctacgcgttctacggtacggtacggaacgaaaacgcaacaatgcactttgcactgcaaattgaggaaaacttctatggacttcagactcgcacgacgacttcgcactacttgctcttcggcatgatcatgacgcctaccgtctatctctgcgcattcaccggcacggtgaaaactgtgaccatctgtgacactaccatccattgtatcctttactttcaactggcacaactaaagctacggatcgtgacgcaggacaacacgttccgccaggagttgaagacggtgatcaagatgcatcaggatgcgcttaactgtgcaagcctgcttgaatctatcacgtcactggtgctgttgctccagctgattctatgcgtattgatctggagctcaatgctcctttacttcaccgtgtcaggattcgatctaaattttattagcctgattatcttgttcgtgttcgatacaacggaaacctttgcctactgttatcttggggaactgttatcgtacgagagtgctcgtatagcacacatcgtttacaaaaacggctgggagcgacaacacgcgtacgtacaaaaagatcttcaggtaattatcgcgcgcgcacaaaggcctgttggcattaccgctggcaaattttgctacatgaacatggcacaacttggcattatagtgaaaactacctactctttctttgttatattgagggatcagatttaa

SEQ ID NO: 35 - protein, 395 aa, Anopheles gambiae
MTSFKPTDDTDVMPLVLRLLRVIGVWDVPQYRYRYAAVFLSYCFGILIPKLCFGYPTLEASIRGYTELILETNVFAGMLQLYLCYNHFVPLVDELRAFAAIVFQDNQPMLLRTNLTDLNLRIHKYTLCYCLYMCCVCTVYCVAPLGSNIAGYTAAMADTASNSSTTFAFTLYLEQGFYWLDNRTSLLGYCVCTVFMLPLMYLCAYTATVKVVAVFNMIKYCQTVLRIVVLKLRLLKTLPDVRQRSDGMSEVWVLHQRALRCAELLELVLQPLLLMQFVLCILIWCMMLLYFTVSGLNVKFINMFLLFLFVSIETFGYCYLGTQLSQESINVGQALYASGWYEYDVQMRKHISFMIMRSQRRVGLTAAKFCFVDMEQFGAMLNMSYSFFVVLKDAF

SEQ ID NO: 36 - DNA, 1188 bp, Anopheles gambiae
atgacttcgttcaagccgactgacgacacggacgtaatgccgctagtgttacgcctgctgcgagtcatcggagtctgggacgtgccacaatatcgctacaggtacgccgcggtttttctgtcctactgtttcggcattctcatccccaaactgtgtttcggctatccaacgctggaagcatcgatccgcggttacaccgagctaatactcgaaacgaacgtatttgccgggatgctgcagctttatctgtgctataatcacttcgtaccgttggtcgacgaattgcgagcattcgctgctattgtgttccaagacaatcaacccatgttacttaggaccaacctcacggatctgaaccttcgcatccacaagtacaccctgtgctactgtctctacatgtgctgcgtctgtacggtgtactgtgttgcaccgctgggcagtaacattgccggctacaccgcagcgatggcagatacggcgagcaacagcagcaccacgttcgcctttaccctctacctcgagcagggattctactggctggacaatcgtacctcgctgcttgggtactgcgtctgtaccgtgttcatgttgccgctcatgtacctttgtgcctacaccgcaacggtgaaggttgtggctgtttttaacatgatcaagtactgccaaacggtgctgcgaattgtagtgttaaagcttcgtctgctgaagacactgccggacgtacgccagcgatccgacgggatgtctgaggtatgggtacttcatcagagagcgcttcgctgtgccgaactgctggagctggtacttcagccactcctgctcatgcagtttgtgctgtgcatcttgatctggtgtatgatgctgctttacttcactgtttctggcctcaatgtaaagtttatcaacatgtttctgctatttctgttcgtgtcgatagaaacgtttggctattgctatctcggaacgcagctctcgcaggagagcatcaacgtcgggcaggcactgtacgcttccggctggtacgagtacgatgtgcaaatgcgtaagcacatcagcttcatgattatgcgatcgcagcgccgggtagggctaacggcggccaagttttgcttcgtcgatatggagcagttcggagcgatgctcaacatgtcgtattccttcttcgtggtacttaaggatgcattttaa

SEQ ID NO: 37 - protein, 398 aa, Anopheles gambiae
MLRLSPEDPKAVMPVVKRLLKLSGLTQETTRFGAINFLNLFIYIAAVLVPKVCFPYPNTEAMIRGLSELIFFTNVYVGFFCFISQHRHYRDLLNAIDSFVDVVYPTAAHPSDSPSEQILIKFNVKIQKLSVVFCWYIAVTATFYWLAPCLMTYRSIYMASVSVENGSVQSIQYYPNLEESFYWLDNRTSVRGYAVLSVVAFITFIFAVYSQTTKLLTILSTIKYCSTLLQLVNIAIEGLSSISPENIDLELKKLIQMHQLAIRCVALLNQTLSYVFALQLVLCMLTWCFTLLYVLVVRLDVTSMMSLLIMINLTPEMFGYCFFCSDLTTTGTTISRQMYEFQWERHRPAIQKTVAMVIARGQARLRITAWGIIPIDLELFAKVVKASYTVLLVLKDFI

SEQ ID NO: 38 - DNA, 1197 bp, Anopheles gambiae
atgttgagattaagcccagaagacccgaaagcagttatgcctgtcgtgaagcgtctgttgaagttgtccggattaacccaagagacgacgcgctttggcgcaatcaacttcctgaatttgttcatctacattgctgccgttttggtaccgaaggtgtgctttccctatcccaacaccgaagccatgatacgaggcttaagtgagctgatctttttcaccaacgtttacgtgggcttcttctgcttcatcagtcagcatcgccactatagagatctgctgaacgcgattgactccttcgttgatgtggtgtaccccactgcggctcatccgtcagattccccgtcggagcaaattctgatcaagtttaatgtaaagatacaaaagctatcggtagtgttctgctggtacatagcggtgacagccaccttctactggctggcaccatgtctgatgacgtaccgctctatatacatggcatcggttagtgttgaaaatggatcggtccaatcgatccaatactaccctaacctggaggaatcgttttactggcttgacaatcgtacttctgtgaggggttatgccgtgttgagtgtagtggcattcataacatttatatttgccgtatatagtcaaactacaaagctactaacgatcctgtccacgatcaagtactgcagcacactgcttcagctcgtcaacatcgctattgaaggattgagcagtataagtccagaaaacattgatctagagctcaaaaaactcatccaaatgcatcagctggcaattcgctgtgtcgcactgctcaatcaaacgttaagctatgtattcgctcttcagctggtgttgtgcatgttgacctggtgcttcacgcttctatacgtcctagtcgtcagactcgatgtgacatcgatgatgagcttgctgataatgatcaatttgacgcccgaaatgtttgggtactgctttttctgcagcgatcttactaccaccggtacaaccattagccggcagatgtacgagttccaatgggaacgacatcgtcctgcgatacagaaaacggttgcaatggttattgcccgtggccaagcacggctacggattacagcgtggggcattattccaatcgatctcgaattgtttgctaaggttgtcaaggcatcttacaccgttcttctcgtgctaaaggatttcatctag

SEQ ID NO: 39 - protein, 398 aa, Anopheles gambiae
MLRLSPEDPKAVMPVVKRLLKLSGLTQETTRFGAINFLNLFIYIAAVLVPKVCFPYPNTEAMIRGLSELIFFTNVYVGFFCFISQHRHYRDLLNAIDSFVDVVYPTAAHPSDSPSEQILIKFNVKIQKLSVVFCWYIAVTATFYWLAPCLMTYRSIYMASVSVENGSVQSIQYYPNLEESFYWLDNRSSVYGYATFSIVALLVFTVASYNNATKLLTILTTIKYCNTLLQLVIIEVDNLNHATSNAIDRELKQVIQLHQRAVRCVALLNQTLSFVMTVQLALCILTWCFTLLYILTVGLDVTGMNGLLIMFNMTLEMFGYCFFCTELATTGTLIACQSYEFRWEEHDPKIQKMISTIVARSQLPLRITACGFITVNVELFAKVVKTTYSGFIVLKDFI

SEQ ID NO: 40 - DNA, 1197 bp, Anopheles gambiae
atgttgagattaagcccagaagacccgaaagcagttatgcctgtcgtgaagcgtttgttgaagttgtccggattaacccaagagacgacgcgctttggcgcaatcaacttcctgaatttgttcatctacattgctgccgttttggtaccgaaggtgtgctttccctatcccaacaccgaagccatgatacgaggcttaagtgagctgatctttttcaccaacgtttacgtgggcttcttctgcttcatcagtcagcatcgccactatagagatctgctgaacgcgattgactccttcgttgatgtggtgtaccccactgcggctcatccgtcagattccccgtcggagcaaattctgatcaagtttaatgtaaagatacaaaagctatcggtagtgttctgctggtacatagcggtgacagccaccttctactggctggcaccatgtctgatgacgtaccgctctatatacatggcatcggttagtgttgaaaatggatcggtccaatcgatccaatactaccctaacctggaggaatcgttttactggcttgataatcgtagttctgtgtacggttatgccacatttagcatagtagcgttgctagtgtttactgtcgcttcgtacaacaatgccacaaagctgctaaccatcttaaccacgatcaagtattgcaacacgcttcttcagctggtcattatagaggttgataacttgaaccacgccacctcaaatgccatcgatcgagagttgaaacaagtgattcaattgcatcagcgggctgttcgctgtgtcgcgctactcaatcaaacgctaagctttgtaatgaccgtacagctcgctctttgcatcctgacctggtgcttcacgcttctctacatcctcaccgttgggctggatgtgacgggaatgaacgggttgctgattatgttcaacatgacgctcgaaatgtttggctactgtttcttctgcaccgaactagccaccaccggtacgctcattgcctgccaatcgtacgagttccgatgggaggaacatgatccgaaaattcaaaaaatgatttcaaccattgtggcccgcagtcagctaccgctacgcattacggcgtgcggtttcatcacggttaacgtggagctgtttgccaaggtcgttaagacaacttactcggttttcattgtgctgaaggatttcatataa

SEQ ID NO: 41 - protein, 395 aa, Anopheles gambiae
MLRLSPEDPKAVMPFAKRLLRLSGFRQETEQLEKQIFFNLFVYVAALLIPKVCSPYPDSEAIIRGLSELIFFTNVYVGYYCFVVQHRHYRDLLDEIQSFVNVVYPTSQQPESPSERTLIKLNVKINKISVLYCWYLAAAGLIYWSTPCLMTYHSVLKAKAEYGPNHPIRFYPNLEGSFYGLDNRTSVYGYAAFSIVALLVFAFASYNNATKLLTILSTIKYCSTLLQLVGVEVDNLNHTSSEAIGRELKKVIQLHQLALRCVALLNQTLSFVMALQLALCILTWCFTLLYILIVGFNAIATNGLLIMINMTLEMFGYCFFCTELDTTGKIVSRQMYEFRWEQHRPTVQKMVAMIIARSQTPLQITACGFIPINLELFTKVVKHSYTVLAVLKDLI

SEQ ID NO: 42 - DNA, 1188 bp, Anopheles gambiae
atgttgaggttgagcccagaagatccaaaggcagttatgccgttcgcaaagcgtcttcttcggctgtctggttttagacaggaaacggaacagcttgaaaagcaaatattcttcaatctgttcgtctacgttgcagcgctattgattcctaaagtgtgctctccgtaccccgactccgaagccattatacgaggcttaagtgaactgatctttttcactaacgtttacgttggctactactgcttcgtcgttcagcatcgccactacagagatctgctcgatgaaattcagtccttcgtaaatgtcgtatacccaacatctcaacaacccgaatccccatcagaacgaaccttgatcaaactaaacgttaagataaataaaatttcggttctctactgctggtacttagcagcggcaggcttgatttattggagcactccatgcctgatgacgtaccactcagtactcaaagcaaaggcggaatatggaccgaaccacccaatccgattctaccccaacctggagggatcgttttacgggcttgacaaccgtacttcggtgtatggctatgccgcgtttagcatagtagcattactagtctttgcttttgcttcgtacaacaatgccacaaagctgctaacgatcctgtccacgatcaagtactgcagcactcttctacagcttgtaggtgttgaggttgataacttgaaccacacctcttcagaagccatcggtcgagagctgaaaaaggtcatccaactgcatcagcttgctctgcggtgtgttgctctgctcaaccaaacgctaagctttgtaatggctctgcagctagccctatgcattctgacctggtgcttcacgcttctctacatcctgatcgtcggattcaatgcaatcgcgacgaatggtttgctgattatgatcaatatgacgcttgaaatgtttggctactgctttttctgcaccgagcttgacaccacgggcaagatcgttagcaggcaaatgtacgagttccgatgggaacagcatcgtcccacggtacagaaaatggtggcgatgattattgcccgcagccaaactccgcttcaaattacggcgtgcggctttatcccgatcaatctcgaattgttcactaaggtggttaagcactcctacacggttcttgccgtactgaaagatctgatatag

SEQ ID NO: 43 - protein, 388 aa, Anopheles gambiae
MFSLGKSHQYLELSYNRIYEVFHWFLKISLLRIFDDDFLVAPVPTTLFQFHETELVVSLGVILLHAYCYRNDLDTIILSVSAFVSAFELMLKINGMVYRRKQIAAMLRTVLSDRSSLNGPIEAVICGKYQRLARKLLLVTILSYLTTGAMLLIYPVVSGGLADRTLPLGYSIPFADYRTHPWYLINYLLQIVQVQWVALVFVGLDGPFYLFVCYSASQLEILIVYLRQIGERPDNVQEQRRLMRKVFEIHTGLSQFIARCSSIYREVYLMQVLCSIVHICVSLFHIQIKFKNGSYGMLLTNVNKIWLFCYCGELVVSKAGEVNTGVYANQWYRLWNRRDLHDILFMLRNAQRNYGFSIGGFGFLSFATFTAVMKTAYSCNAFLHRVMN

SEQ ID NO: 44 - DNA, 1167 bp, Anopheles gambiae
atgttctcgttgggcaaatctcaccagtacctcgagctgagctacaatcgcatctacgaagtgtttcattggtttctgaaaattagcctgctgcgcatctttgacgatgactttctggtggcccccgtaccgaccactttgtttcagtttcacgaaacggagctggtcgtttcgctcggtgtcattctgctgcatgcgtactgctaccgcaacgatctcgacacaatcatactgagcgtgtcggcgtttgtgtccgcgttcgagctgatgctcaaaatcaacggcatggtctatcggcgcaaacagatcgcggcgatgctccgtaccgtgctgagcgatcgcagctctctgaacggtccgatcgaggctgtcatctgcgggaagtatcagcgcttagcaagaaagctcttgctggtcacaatcctgtcctacctgacgacgggcgcaatgctgctaatctatcccgtggtgtcgggtgggctcgccgaccgaacacttccactgggctattcgataccgtttgctgactaccgcacccatccctggtatctgatcaactatctgctgcagatcgtgcaggtgcagtgggtggcgctggtgtttgtggggctggatggtcccttctacctgtttgtgtgctactcggcctcccagctggagatattgattgtgtatctgcgccaaattggcgaaagtcccgataacgtgcaggagcagcggcgattgatgcggaaggtgtttgaaatccacaccggactttctcaattcgttgctcgatgttccagcatctaccgggaggtgtacctgatgcaggtgctctgctcgatcgtccacatctgtgtgtcgttgtttcacattcagatcaagtttaaaaatggttcatacggcatgctgctcacaaatgtgaacaaaatatggctattctgctactgtggtgagttggtcgtcagtaaggcggctgagttcagtaccggcgtgtacgcgaatcagtggtaccggctgtggaatcgacgggatctgcaggacattctgtttatgctgcggaacgcccagcgcaactatggcttcagcatcggcgggtttggctttctgtcctttgccacctttacagcggttatgaaaactgcctacagctgtaacgccttcctgcaccgggtgatgaactga

SEQ ID NO: 45 - protein, 380 aa, Anopheles gambiae
MRWRKDETGLHTPQCTVDLPGDGSHSVSVRKPLLDRDRLGIADGCCVLLCYAGNRYTGELMKFYFEHSITHHGPSAQGLAKIEAFTCPELNDLHLYNVARFKAPPRFPEVDEALFHTATMCMVFIRIFAVAFSIVAIAIYSYAILMPLIEHELSLAFGFYLPFVDYRTPVGFAINWVYQFVQVLEGCIGLMACDSCLLVLIMNATGQMDVIIVYLKQLTLLIDNNHTGQHDEEIADIIKEIVLKHLEHTKYMTDMDKLLKKQFFINFGCMIFELVASLAIVVRVPWYPGMAICLICTNQLFINCALGTFLSSKNEKLVEEIYNVNWYGLTTKHQKTLQQILLTSQHPVVLSDGFSPIDLFNFVEIYKKIYSYLMVLQKVS

SEQ ID NO: 46 - DNA, 1143 bp, Anopheles gambiae
atgcggtggcgaaaggatgaaaccgggctacacacgccgcaatgcacggttgatcttcctggtgacggatctcattctgtatctgttcgtaaacctctactcgatcgcgatcgtttggggatcgctgatggatgttgtgttttgctttgttacgctgggaatcgctatacaggtgagttgatgaagttctactttgaacactccataactcatcatggcccctctgcacagggtctagcaaagattgaagccttcacctgtccggagctgaacgatctgcatctgtacaatgtggcacggttcaaagcgccccctcgcttcccggaagttgacgaggcactcttccacaccgccaccatgtgtatggtgtttatacgcatattcgccgtagcgttctcgatcgtcgccattgccatctactcgtacgccatcctgatgcctttgatcgagcacgaactatcgctcgcatttgggttctatctgccgtttgtcgattatcgcacgcctgtcggatttgccatcaactgggtgtatcagtttgtgcaggtgctggaaggatgtattgggctgatggcgtgcgactcctgtctgctggtactgatcatgaatgctaccggtcagatggacgttatcattgtctatctgaagcagctgacgctactgatagataataatcacactggacaacatgatgaggaaattgcagatattataaaagaaattgtgctcaagcatttagagcacaccaagtacatgacggacatggataagcttctcaaaaagcagttcttcatcaactttggatgcatgattttcgagctcgttgcatcactagcgatcgttgttagggttccttggtatccaggtatggcgatctgtctgatttgcaccaatcaactctttatcaactgtgcattgggaacattcctatcatcgaagaatgaaaaactggtggaggagatctacaacgtaaactggtacggactgacgacgaagcaccagaagacacttcagcaaatattgctcacctctcaacatcctgtggtactctccgatgggttctcacctatcgatttgttcaactttgtagagatatacaagaagatttattcctatttaatggttttgcagaaagtatcttaa

SEQ ID NO: 47 - protein, 377 aa, Anopheles gambiae
MDLTAGIESFNKSMGVSFFKRKHSFVNFFFIFGISNLVLYVVSVLISSYKSRHDIIKLIYCIATFGFCCQAIMKIYSFIITRQRVVDLYEINHRYYQHMMGQSIAVKRVLCDNASLIYIVIKVTVLAYLLLVITAMSIPGLSSIFLADRILPFGFVMPFIDANTLAGYYANYGIQLIMAIYYWIITVGSDITTIYNLLTAYGQLDVLMTITEELNEQLERNESLDTIQDKIVEIIRQYQHHRTYLKQLVDFLNPYHFVTLISTVPTMVISVLGLVLLDWYPGAAIVFLGSVQIFYICFLGTSLELKGGVTNALTLKIGAIHWDKLSGRDMKFMKMVLMMSQKPKMLMAATLPLNITAFLQIHKFIYSLIMMLENTKG

SEQ ID NO: 48 - DNA, 1134 bp, Anopheles gambiae
atggatttaactgcgggaattgagtcctttaacaaatcaatgggagtgtcttttttcaagcgcaagcattctttcgtcaacttcttctttatcttcggtatcagcaacttggtgctctacgttgtgagtgtgttaatttcgtcgtataaatcgcgccacgatattattaagctaatctactgcattgctacatttggattttgctgtcaggccattatgaaaatatacagctttattataactcgtcagcgagtcgttgatttgtacgagatcaatcatcgttactatcaacatatgatgggtcaaagtattgcagtcaagcgtgtgctgtgtgataatgccagtcttatttacatcgtgattaaagtgactgttctagtttatcttctattagtgataacagcaatgagcattcctggtttgtcatcgatatttctggcagatcgcatactgccgtttggatttgtcatgcccttcatagatgcaaacacattggctgggtactatgccaactatggcattcagcttataatggccatttactattggatcatcacggttgggtctgacatcactaccatctacaatctactgactgcgtacggccaactggacgtcctgatgactatcacagaggaactgaatgaacagcttgaacgtaatgagagcctcgatacgatccaagataaaatagttgagatcatacggcagtatcagcaccatcgaacttacttaaagcaacttgtagactttttgaatccataccactttgtaacgctcatctcaacggttccaactatggttatctcggtgctgggattggttttgctggattggtatccgggggctgctattgtgtttcttggatcggttcaaatattttacatttgctttcttggaaccagcctcgaacttaaggttggagttaccaatgctctcacgttgaaaattggtgccatccattgggataaactctctgttcgagacatgaagttcatgaaaatggtgctaatgatgtcgcaaaaaccaaaaatgctgatggcagccacgttacccttaaacattacggcgtttttgcagattcataagtttatatattcattgattatgatgctggaaaacactaaaggttga

SEQ ID NO: 49 - protein, 357 aa, Anopheles gambiae
MEQEINQIISFLRRPLKWLGFDVIDPNWKVTPLTMFTIVMFALQHYTTYLYLSTHLDMFDMFTECFSTSAVALEIAIRMGLLVHQRELRNETIEIIRQQQKVTARFHKLISVTLHALAACYMSTMMFELIPIVSPNPRKSNLPLPMYLPYMPHDVTPYWHLNYTFITVMNLMCILFLVGIDGLLVLSILAAVHQIKLLKITIQELDIGAEQAELHRELVRIIQIHQRIQQFIHQLEQTYYIDLLVDFGLVCLILCMGLNVIADEVINAIWFFLIAVVFQLSLLCFSGNLLLIESDSLSSCVYSIDWHTMPVPEQKLLMVMIAHAQKPQVLRGIFMPLIMSSFLSVIKASYSYFTLLH

SEQ ID NO: 50 - DNA, 1074 bp, Anopheles gambiae
atggaacaagaaatcaaccaaataatctcctttctgcgacgccctttgaaatggctcggttttgatgtgatcgatccaaactggaaggtgacgccgttgacaatgttcacgattgtcatgtttgccttgcaacactacaccagctacttgtatttatctacccatctggatatgttcgatatgttcaccgaatgcttttccacatcggccgtcgcgctggagatagcgatccggatgggcctgctggtacaccaacgcgagctgcggaacgaaacgatcgaaatcatacgccaacaacagaaggttacggcacggttccacaagctgatttccgtgacactgcacgcacttgccgcatgctacatgtcgacgatgatgttcgagctgatcccgatcgtgtctcccaatccgagaaagagcaatcttccacttccgatgtacctgccgtacatgccgcatgatgtgacgccctactggcacctgaactataccttcatcacggtcatgaacttaatgtgtatactgtttctggtcggcattgacgggctgctggtgctgtccattctggctgccgtgcaccaaatcaagctgctaaagataaccatccaggagctggacatcggtgcggagcaggcggagttacaccgggagcttgtacgcattattcagatacatcaacgcatccagcagttcatccaccagctagaacaaacgtactacatcgatctgttggtggactttggtcttgtttgtttgatcctgtgcatgggactgaacgtgatcgccgacgaagtaatcaatgcgatctggttctttctgattgcggtcgtatttcaactatctttgctatgcttcagtggcaatctactgctgatcgagagcgactcactgtcgagctgtgtgtactcgatcgattggcacgcgatgccggtgccggagcagaagctgctcatggttatgatcgcgcacgcacaaaagcctcaggtgctgagaggcatctttatgccactgatcatgtctagcttcctgtcggtaattaaagccagctactcctatttcacattgttgcattaa

SEQ ID NO: 51 - protein, 400 aa, Anopheles gambiae
MDSNSKKDTFPLIQISTKMLQIIRLWNESSGQRMSTFGVLLIAVFPIMWLIPSWLFIVSSQDNIKRLMKAINEQIVFCIVFLKFSFYAIHFRRWEQLFYDLQRSFSTVVNNPSLEIQTILGHVTKSTHKLTKYYCSIVSFNCAAYGLFPMLFIVVKYAVTGSYDVPLSTPIEGKYSIPGFRTNFWVWLPFNLAQNVVLQCHSFAVITIECFTWNLVYATSCMFRILQIQATELLDRSRDKKEWNIKFKTFIALHDSVLRSARTLEAILSGQILLLYVSTILAVCLGMVVLTLAIEDVYLLLTTFVAFGYCMFQMFSFSYLGTELIEQSEAVADGIFNSKWYEEDVKVQKDLSFVLMRAKKPVRLTAAKLFVVTRDSFTQVMKQAYTIFALMSQFLDDIAN

SEQ ID NO: 52 - DNA, 1203 bp, Anopheles gambiae
atggatagtaacagtaagaaagatacatttcctctaattcagatttccactaagatgttacaaattatccgtttgtggaatgaatcatctgggcaaagaatgtcgacattcggtgtgctattgattgccgtgttcccaataatgtggcttatccctagctggttgtttatagtaagctcgcaggacaatatcaagcgtttgatgaaggcgatcaacgaacagatagtgttttgtatagtgtttttgaaatttagcttctatgcaattcattttcgtcgttgggagcagttattttacgatctgcaacgttcgttcagcaccgttgtgaacaatcccagtctcgagattcaaaccatattgggacacgtaacgaaatcgacccataagctcactaaatactattgctctatagtaagcttcaactgtgctgcgtacggcttatttccaatgttgttcatagtggttaaatatgccgtgacgggctcgtacgacgtaccgctttcaacaccgattgaaggaaactattttatacccggttttcgtacaaacttttgggtttggttgccctttaatttagcccaaaatgtggtgctgcagtgtcatagctttgctgtaattaccattgaatgcttcacatggaatcttgtgtatgccacatcctgtatgtttcgaatcctgcaaatccaagccaccgagcttttagatcgaagtcgggataaaaaagaatggaacatcaagtttaaaacattcatagctctgcatgattctgtgctgagatcggctaggacacttgaggcaattttgagcggtcagatattattactttatgtttctacaattttggctgtatgtcttggaatggtagtgctgaccctggccatcgaagatgtttatctcctgttaacaacgtttgtcgcatttggctactgtatgtttcaaatgttttccttctcttatctcggcactgagctcatagagcaaagcgaagcagtagcggatgggattttcaatagcaaatggtatgaggaggatgtaaaagtacagaaagatcttagcttcgtactgatgcgagcaaagaagccggtaagattgactgcagcaaagttgttcgttgtaacacgtgactccttcacccaggtaatgaaacaggcgtacactatatttgcattgatgtcccaatttctggacgacattgcgaattaa

SEQ ID NO: 53 - protein, 400 aa, Anopheles gambiae
MKPSCKEGVFPLINLSIKLLKIVGFWSKTTGQRISVIGLLAVILYLLAWLIPNWLFIVSSQDNITRLIKATNEQILYFIAFFKLYFYVIHYRRWEKLFYDLQIAFSSVMTNPSPEIQGILGHVTKSTHNLTKYYSYVVNFNCAWYGVFRMLFIVVKYAVTGSYDVPLSTPIEAKYFIPGLHTNFWVWLPVTLGLNVLLEWHSLALVFVETFIWNLVYATSCMFRILQILANELSDRKRNEGIWTVEFEKFSTLHDSVLRSAGTLEEILSGHMLLLYVSTIFSLCLSMVVLSLPIDDFILLLTTFVAFGYCIFQTFSFSYLGTELIEQSEAVADAIFHSKWYTQKLNRQKDMCFLMMRANKPVKLTAAKLFVVTRDSFTQVIKQAYTIFTLMSQFLDNPVN

SEQ ID NO: 54 - DNA, 1203 bp, Anopheles gambiae
atgaagcctagctgcaaggaaggtgtatttcccttaataaacctcagcataaagctattgaaaatagttggtttttggagcaaaacgacggggcaaaggatttcagttattggtttactggcagttatattgtatcttttagcgtggcttatcccaaactggctgttcatagtgagctcgcaggacaatataacacgactgataaaagcgaccaacgagcaaatactgtactttattgccttcttcaagttgtacttctacgtaatacattatcgacgctgggagaagctgttttacgatctgcaaattgcgtttagctcggttatgaccaacccgagccccgaaattcaaggaatattgggacacgtaacgaaatcgacccataaccttaccaaatactacagttatgtagtaaatttcaactgtgcatggtacggtgtgttccgaatgttgttcatagtggttaaatatgccgtgacgggctcgtacgacgtgccgctttcaacaccgatcgaagcaaagtattttattcccggcctgcatacaaacttttgggtttggttgccggtgactttaggactaaatgtactgctggagtggcatagcttagctttggttttcgttgaaaccttcatatggaatcttgtgtatgccacatcctgtatgtttcgaattctgcaaatcctggccaacgagctttcagatcgaaaacggaatgaaggaatatggacagtagagtttgaaaaattctcaactttacatgattctgtgttgagatcggctgggacactggaggaaattcttagcggacacatgcttttgctttatgtatcgaccatattttccctatgcctgtcgatggttgttttgtctttgcccatcgatgactttattttgctgctaacaacatttgtcgcatttggctactgtatttttcaaaccttttccttctcttacctcggcactgagctcattgagcaaagcgaagcagtagcggatgcaattttccacagcaaatggtacacgcagaagctgaacagacagaaagacatgtgtttcttgatgatgcgagcaaataagccggttaaattgactgccgccaagttgttcgttgtaacacgcgattccttcacccaggtgattaaacaggcgtacacaatctttacattgatgtcacagtttttggacaaccctgtgaattaa

SEQ ID NO: 55 - protein, 420 aa, Anopheles gambiae
MARLVLHEVRYVLMAMLYISRGMATKIQNSPIDLYVYWFLTFIPIASLCVPQIIFRVKMLKQTKQIIHFYLSLQFTYLVVDTKSLIDFISVLVPITEILLTNGKMIICNVKRGKIINLINQVQVAWDEGAKSEHLEIQTLITTTAKKSKIFVIIYTTSFLLICVEYSSMPLFKLIYHSAVYGKQSNYTIALPYLSRFAYSTESTTSFAWTYFFILIGVYLLALTLSGFDSLFSTLVMHIKMMFKVLKFEIEQLGLDLSAGKSHVELQAKLKQIILKHKTNLSLIEQLEDGFSFFLMAQFLTSSILVCVVLYELTMVFGWNEDTFKTVTYLPGAILQLFLFCWYAQQITEEARLVSDHIYNIPWYLADPKLQKDILTFMVKAQKPTGVTASKFYMVTLQTFQRISSTSYSYFTLLQTINQQ

SEQ ID NO: 56 - DNA, 1263 bp, Anopheles gambiae
atggcccgtttggtactgcacgaggtgcgctacgtgttgatggcgatgctttacatatctcggggtatggcaacaaagattcaaaattccccaattgatctgtacgtctactggtttctgacgttcatcccaatcgcttcgctgtgtgtaccgcagatcatttttcgtgtgaaaatgctgaaacaaacaaaacaaataatccatttttacctttcgctacagttcacttacttagttgtagataccaaaagccttatagatttcatctcagtactggtacccattacggaaatcctgctaacgaatgggaaaatgattatatgtaacgtaaagcgggggaaaattatcaatctcatcaaccaggtccaggtggcatgggacgaatgtgcaaaatcggaacacctggaaattcagacattgattacgaccactgccaaaaagtcgaaaattttcgtcatcatctacacgacctctttcctgcttatctgcgtcgagtatagttcaatgccgttgttcaagttgatctaccacagcgcagtttacggtaagcaatccaactacactatcgctctaccgtacttgtccaggttcgcttatagtacagagtccacgaccagctttgcgtggacgtatttcttcatactgatcggagtctacttgctggcgctaacgctcagtggctttgatagcttgttttcgacgcttgtcatgcacattaaaatgatgttcaaggtgttgaagtttgaaatcgagcagctgggactggatctgagtgccggaaagagtcatgtcgaactgcaggccaagctgaaacaaatcattttgaagcacaaaaccaatttatccttgatcgaacaattggaggatggtttcagtttctttttgatggcgcagtttctaaccagctcgattttggtttgcgtcgtgctatatgagctaactatggtgttcggatggaatgaggatacgttcaaaacggttacctacctgccaggcgccatcctgcagctctttctgttttgctggtacgcgcaacaaattaccgaggaggcgcgattggtgtcggaccatatttacaacattccttggtatctggccgatccgaagctgcagaaagacattctcacattcatggttaaagcccagaagcctaccggtgtgacggcgtccaaattttacatggttacgctgcaaacctttcagcgaataagcagtacatcttactcctactttaccttactgcaaaccatcaatcagcaataa

SEQ ID NO: 57 - protein, 386 aa, Anopheles gambiae
MKLFQIDDPREVVPIGCRLLKLFGLGRDEKLKLLYWVQCVFYLVFSIIPRVLVQIDDTIMVLRLGSELAFVSYLYCQILGLYFRRSYLYRLVDLLQTCINKQYSESIDQFVIKSNTKINKLSVTCCKYFTIAYVLYCAMPPIASTVVYVRNQRNKTAEPEEFIISSEMKCVLYYLNIRFNLLHFSFYTIVICLLTITSAGSLCIKDIMDVAVIKTTCLLFQTTAMQIRELKDNISQAQLSVVIKSHRDTLLCAQYLQEALNLSLLFQLTFCSLIWCLMMFYILLMGFDSRILNVLILLLIVTVETYTYCTLGTQLTDKGEEVLMALQQLAWYDQSIPIQKQLLFMIRRSQKPIILSAGKIFYANVLQFSEMVQKSYSFYLVLKNVF

SEQ ID NO: 58 - DNA, 1161 bp, Anopheles gambiae
atgaagctattccagattgacgatccccgtgaagtcgtcccgatcggttgccggctgctgaagctgttcggtctggggcgtgacgaaaagctgaagcttctctactgggtccagtgtgtgttttatctcgtgtttagtattataccacgcgtcttggtgcagatcgacgatacgataatgttgcttcggttgggctccgagctcgcctttgtctcctacctttactgccaaattttgggcctgtattttagacgcagttatctgtatcggctggtggatttgcttcaaacctgcataaacaaacagtactcggaatcgatcgatcaatttgtgatcaaatcgaataccaaaatcaacaaactttctgtgacttgctgcaaatattttacaattgcgtacgttctgtactgtgcgatgccaccgatagcatcgaccgttgtgtacgtacgcaaccagcgcaacaagacggccgaaccggaagagtttatcatttccagcgagatgaagtgcgtcctctactacctgaacattcgattcaatctgttgcacttttcgttttatacgatcgttatctgtctgctaacgatcacatccgccggttctctgtgtatcaaggacataatggatgtggccgtcatcaagaccacttgcttactattccaaacgacggccatgcagattcgcgaactcaaagataacatctcgcaggcacagctaagcgtcgtcatcaagtcgcatcgggacaccttgttgtgcgcacaatatctgcaggaagctctcaatctatcgcttctgtttcagctcacgttttgcagcttgatatggtgtctgatgatgttctacattttgctgatggggtttgactccagaattctgaacgttctcatactactgcttatagtgacggtagagacctacacgtactgtacactcggaacgcagctgacagataagggtgaagaggtcctgatggcgctccagcagctcgcttggtacgatcaatcgatcccgattcaaaagcagcttctcttcatgattcgacgctcgcagaaaccgatcatcctgagtgctggcaagattttctatgccaatgtactgcagttcagtgagatggtgcaaaagtcttactcattttatttggtactgaaaaatgtgttttaa

SEQ ID NO: 59 - protein, 376 aa, Anopheles gambiae
MKFFQIDDTREILPIGCRLLMLCGLPRSGRVNRRFWLLCVFFFVFGQIPRFLIKIDEPIALVRVGAEIVYSTYMFLQLIALYARRSDLYRLIDTLQKCVENPYPDDVRAFILITRDTINKSSVMYSKCFFAVCISYIIMPFMATSAVVVRNRRNQTGEREDFYYLDIRFNLLHYSLYFGAVSGLSVIGSLALCTKDVMDFSLIRTASMLFQATAQQIRNLPPGASQAKLEAIIHSHRSTLKCAAQLQNALNPALLIQITFCTAIWCLMLFYILLLGFTSKVMNVCLLLLVLTCETYSYCQLGTQFTSNAEEVLDELQQLARYDQSIPIQKQIYFMIHRSQTRIELTAGKLFPVNIAQFSEIVKKSYSYYLVLKDIF

SEQ ID NO: 60 - DNA, 1131 bp, Anopheles gambiae
atgaagttcttccaaatcgacgatactcgcgagatactgccaataggttgccgattgttaatgctttgcggtttgccccgcagtggccgtgtgaaccgcaggttctggcttctgtgtgtttttttcttcgtcttcggtcagatcccacggttcctaattaagatcgacgagcctattgcgctggtgcgcgttggtgctgagattgtgtactcgacgtatatgttcttgcaactgattgcactgtacgctaggcgaagcgatctttatcggctaatcgatacgttgcagaagtgtgtcgaaaacccctacccggatgatgtgcgtgcgttcatcctgatcacgagggacacaatcaacaaatcttcagttatgtacagcaagtgtttttttgccgtctgcatatcgtacattataatgcccttcatggcaacgagtgccgttgtggtgcgaaaccgtcgcaaccagacgggcgaacgggaggatttctactacctggatattcgcttcaatctacttcactattcgctttactttggtgctgtgagtggactaagcgtaataggatcgctggcactttgcactaaggacgtcatggatttttcactcattcgtacggcatcgatgctgtttcaagcaaccgcccagcaaattcggaacctaccgccaggcgcatcgcaggccaagctcgaagccatcattcattcacaccgttccaccctgaaatgtgcagcacagctgcagaatgcccttaatcccgcactgctcatacagatcacattctgcaccgccatttggtgcctcatgctgttctacatacttctgctgggattcacctccaaagtgatgaatgtgtgtttactgcttctggtactaacttgcgaaacgtactcctactgtcagcttgggacacagttcacctcaaacgcagaggaagtgctcgatgaattacagcaacttgccaggtacgatcaatccataccaatacagaaacaaatttacttcatgattcatcgctcccagacgcgtatcgagctgacagctgggaagcttttccccgtcaacattgcgcagtttagtgagattgttaaaaaatcatactcatactatcttgtcctaaaggatatcttctaa

SEQ ID NO: 61 - protein, 373 aa, Anopheles gambiae
MLAAETVDFFRVQSICLRAIGIARTDSFRGRVLFAVSFFTVLVMMLGTVMFAFKHIDQIMLLCDCLGPTFTAYLGLVRQYNLLLHRSELWSIVDEFAALKHSLQSSEIRIVQKYNRIDRFLAWAYLITAMSTGVLFVGVALVLVFLSEKSDWKLPLLMDFPFDVKHPVTFTIFFVWCSVAIFWVVLDCVACDSTFGTFSSCLVAHFVIIQERFEGLRFDDGNRELKKLIEHHKYILRISDRVINAYKNVILNQLLISSVLLCMLGFQLVISVGTNIMVVYVAYGMAITIQVTYYCYYGSQLYYESTQVHDAVFKSKWYDASVATQKMLINCMMRAKKPVNAKSGFTQASLPTLNAILNSAGSYVALLMSLMEZ

SEQ ID NO: 62 - DNA, 1119 bp, Anopheles gambiae
atgttggccgctgagaccgttgactttttccgtgttcaatcaatctgcctgagagctattggcattgcacgaaccgattcgttccgcgggagagttctgttcgcggttagcttcttcaccgtgcttgtcatgatgctgggcacggtgatgtttgccttcaaacacatcgaccaaattatgctgctatgcgattgtctggggcccaccttcaccgcctacctggggctggtgcggcagtacaatctactcctgcatcggtccgagctgtggagtatcgtggacgagtttgcggcattgaagcattcgctccagtcgagcgaaatcaggatcgtgcaaaagtacaaccgcatcgaccggttcctcgcgtgggcttatttgattacggccatgtcgacgggagtgctattcgtgggagtagcgctagtgctggttttcctgtcggagaaatcggactggaaactaccgctgctgatggacttcccatttgatgtgaaacatccggtgacctttacaattttctttgtctggtgcagtgtggccatattttgggtcgtgctggattgtgtggcgtgtgattccacgttcggtaccttttcctcctgcctggtggcccacttcgtcatcatccaagagcgtttcgaggggcttcgctttgacgatggtaaccgggagctgaagaaactcatcgaacaccacaagtacatactacgtatctccgatcgtgtcatcaatgcgtacaaaaatgtcattctgaatcaattgctcatctcatcggtactgctctgtatgctcggctttcagctagtcatatcggtgggtacgaacattatggtggtatatgtggcgtacgggatggccattaccatacaggttacctactactgctactatggatcacagctctactacgagagtacacaggtgcatgatgctgtcttcaaaagcaaatggtatgatgcgagtgttgccacccaaaaaatgttgatcaactgtatgatgagagcgaagaaaccggtgaacgcaaagtcgggctttacgcaagcatctttgcccacgctgaatgcgattttaaattcagctggatcgtacgtagctctactgatgtctctgatggagtaa

SEQ ID NO: 63 - protein, 384 aa, Anopheles gambiae
MSQLNEFPAYQFRLIRFCGVVEQPSLKNNVRCLFAFILLCSFGPLHVWYLAKTPVLDLVVTCEEIMLIQLCFVMLLKFNLFITYRSGMYNLVEAFKRILKCIDKAEFARFVKCSELHAKLLRAYVIGTSIVLLLYELNAIVASITLSLQQNKVCFVTPFRFPFDYQHPIVFALTFLHNFDAMLVTVCTSVTVDSCFSEMASNLTIHFDIVRERFEKLDLSAAQPYAEHQLRNVITYHREVLSLAQKMVQLYQQSAFYLLLLVSTILCLLGYEFVMVSNIYKRMQVAILASIMIGQAAIYTYHGSAISAKSVSVADAIYGTNWYDAPLAVKKLVYICLMRAQKPVIMKSGFIEASLPTLKKILSSSASYITMLMSLEADLNEKKT

SEQ ID NO: 64 - DNA, 1155 bp, Anopheles gambiae
atgtctcagctcaatgaatttccggcctatcaattccgattgattcgtttctgtggtgtcgtggaacaaccatccttaagaaacaatgtgcgatgtttgtttgcatttattctcctttgctcctttggaccacttcatgtatggtatctcgctaaaactcctgtgttggatctggtggtaacgtgtgaagagatcatgctcattcaactgtgctttgttatgctactcaagtttaatttgttcataacctatcgttctggaatgtataatttggtagaagcgttcaaacgcattctgaagtgtatcgacaaagctgagtttgcacggtttgtgaaatgcagcgagctgcatgcaaaattgctgagggcttacgtgatcggtacatctatagtgctgttattgtacgagctgaacgcaatagttgctagcattacgctatccctgcaacagaacaaggtttgttttgtgacaccattcagcttcccatttgactatcaacatccgatcgtgtttgctcttacttttttacacaactttgatgcaatgctggtaaccgtgtgcacaagcgttacggttgactcgtgtttctccgagatggccagtaatcttactatacatttcgatatcgtgcgagaacggtttgaaaaactcgatctttccgctgctcaaccgtatgccgaacaccagttaagaaatgtaatcacctatcaccgcgaagtgttgtcgttggcgcaaaagatggtacaactttaccaacagtcggcgttttatttgctgctgttagtatctacaatactgtgtctgttgggctatgagtttgtaatggtaagcaacatttacaagcgaatgcaagttgcaatattggcttctattatgattgggcaagctgctatttatacctaccacgggtcagctatcagcgccaaaagtgtatccgttgctgatgcaatttatggaaccaactggtatgatgctcctctagccgttaaaaagctggtatatatctgcttgatgcgagctcaaaagcctgtcattatgaagagtggcttcatagaagcatccttgccgacactgaaaaagattcttagttccagtgcatcgtacataactatgcttatgtcgcttgaggctgacttgaacgagaaaaaaacttga

SEQ ID NO: 65 - protein, 373 aa, Anopheles gambiae
MCILAGLLLTLAKKWHCVLYIDELWECVEQMQTYHEHYLLQGEWFVRRMRRQNLQERMLQDASKLLATLLASCLMVNVRIYGILVQEFTIFEDGLRLIFYSTQCSLGTLFQRRNAYPACHLSLQHGHHAWLRVCVRLSGLSDRLRTVQHGADRLYRRASAQPDGATVLHAAQTVRADRGRSSAAPRGPPPRRPVDTGPGVQCDSFTPAVAVVSIGKTRMSLALFSTPERPLLFTGSFCNRLKRLYEPNIMAQFVCSMLIICLTAFELMFAKGDPMQMVRFGAYMLAGFYQVFVWSFFGNRVTNMSTGISDATISCNWIVLADGLKKDLRFTTMRSQKPFVIDVYWLFPLTYETFIAILSRSYSIFTLLRTMIE

SEQ ID NO: 66 - DNA, 1122 bp, Anopheles gambiae
atgtgcatcctggcggggttgctgctaacgctggcgaaaaagtggcactgcgtgctgtacattgacgagctgtgggagtgcgtcgagcagatgcagacgtaccacgagcactacctgctgcagggcgaatggtttgtacggcgcatgagacgccagaacttgcaagagcggatgttgcaggatgcatccaagctgctcgccacactgctcgccagctgtctgatggtgaacgtaaggatttatggcattttagttcaagaattcactatctttgaggatggtctacggctcattttttattcaacccaatgttctttaggcactcttttccaacggcgaaacgcttatcctgcgtgccatctatcccttcagcacggccaccacgcttggctacgggtgtgtgttcgtctgtcaggcctttctgatcgtctacgtactgtacagcatggtgctgatcgattgtatcggcgcgcaagcgctcagccagatggcgctactgttctgcatgcagcgcaaacagttcgagctgatcggggccgatcttcagctgccccccgagggccccctccacggagaccggtcgatacgggaccaggtgtacagtgcgatagcttcacaccagcagttgctgtcgtaagtattggtaagactcgtatgagtttggcactcttttctaccccggagcgccctctactcttcactggcagcttttgcaatcgcttaaagcgcctgtacgaaccaaacattatggcccagtttgtgtgcagcatgctcatcatctgtctgaccgcgttcgagctgatgtttgccaagggcgacccgatgcagatggtgcgcttcggtgcgtacatgctggccggcttctatcaggtctttgtgtggagcttcttcggcaaccgtgtcaccaatatgtcaacaggcattagcgatgcaacgatcagctgcaactggatcgtgctggcggacgggctgaagaaggaccttcgcttcacgaccatgcgctcccagaagccgttcgtcatcgacgtgtactggctgtttccgctgacgtatgaaacgttcatcgcgatacttagccggtcctactcgatatttacgctgcttcgtacgatgattgagtga

SEQ ID NO: 67 - protein, 380 aa, Anopheles gambiae
MYDPGRFIFPMRFSMWAWKVCGFFNAPVPKSVAYRVYCYAFYSCIMAVYLFVLLLNVFVPQPFEQRVFFIMYIFLTETAMILKTLTIYRHFNIVWSLYETTLGVSFQPRDEQERELQQRRLAVFNRWYYAYIFVSHMAAFGTGSHLLSAEYRMPFFPWFFGVPYWEDAHVAYYTICAYQSFGMYFHMLLNTAGDTQLCYMMHMIGIQLELLGKRFRDLNNCEEFDRSFVPLVQHYNKIHRMLCRVQNLFSPAYFVQFSVSGLVICASAYQVASMLNLNDFSKLMNVFYMMSMTMQIGLPCYYGNEVTLKSYALTNAIYSSRWYDMPQSNRKSVQMFLVRTNKPFAVAAFGYFNFNLPAFTTILNMAYSVYCVLQRKAKNV

SEQ ID NO: 68 - DNA, 1143 bp, Anopheles gambiae
atgtacgaccctggtcggttcatcttcccgatgcgcttcagcatgtgggcctggaaggtgtgcggcttttttaacgcaccggtaccaaagtccgtcgcgtaccgcgtgtactgctacgcgttctactcctgcatcatggcggtgtacctgtttgtgctgctgttgaacgtgttcgtaccgcaaccgttcgagcagcgggtgttcttcatcatgtacatctttctgaccgaaacggccatgatcctgaaaacgctgaccatttatcggcatttcaacatcgtctggagcctgtacgaaactacgctgggggtgtcatttcaaccgcgtgacgagcaggaacgggagctgcagcaacgaaggctggccgtattcaaccggtggtactatgcgtacatcttcgtgagccacatggccgcattcggtaccgggagccatttgcttagtgctgagtatcggatgccgttctttccgtggtttttcggtgtcccgtactgggaggatgcacacgtggcgtactacacgatctttgcataccagagcttcgggatgtactttcacatgctgctcaacacggccggcgatacgcagctgtgctatatgatgcacatgataggcatccagctggaactgctgggaaaacggtttcgcgatttaaataactgcgaagagttcgatcgttcgtttgtgccgttggtgcagcattacaacaaaatacatcgcatgctgtgtcgagtacagaacctcttctcacctgcctattttgtgcagttcagtgttagcgggctggtcatctgcgcttcggcttatcaggtagcctcgatgctcaatctaaacgacttcagcaaactgatgaacgtgttctacatgatgtcgatgacgatgcagatcgggctaccgtgttactatggcaacgaagtaacactcaaaagctacgccctcacgaatgccatctactcctcgcgctggtacgacatgccgcaaagcaacaggaaaagcgtgcaaatgtttctcgtgcgcaccaacaaaccattcgcagtggctgcgtttggttatttcaactttaacttgcccgcatttacaacgattttaaacatggcatattccgtgtactgtgtgctgcagcgtaaagcaaaaaatgtgtaa

SEQ ID NO: 69 - protein, 376 aa, Anopheles gambiae
MSCVEDFLDAQMWYLRYCGVFREKSALGGIRLSVCLGVLVVFMVLQSIYIFQHVHHFAMICDAIPTLVVCMVAISKFYIFVFHPAALFALIDSFKALQRRASREDLLLFRRSGAFHAKLTKIYMTSALIVGWFYILSAIVSGISRSLAEGRVHFVAPMAFPHNYQHPLMFALTFLFNCDSIHMSIFIIGSVDTCFSELATSVTIHFQLIQRQFQAVDFAARTAEDELEVVVAYHKDVLQLCLAMTNLFQYTVFYLLLLDSVLLCVIGYQFVIFMNTPRVLMLASMAFVMVLQAVIYCYHGSMMYDESLKVADAIYQSNWYEAPPAEQKRLRLCIMRAQKPIVTKGGFIKATLPTLKKILNSTGSYITMLLSLETEQ

SEQ ID NO: 70 - DNA, 1131 bp, Anopheles gambiae
atgagctgcgtggaagattttctcgacgcccaaatgtggtatttgcgctactgtggagtgtttcgcgagaaaagcgcgctcggtggaatccggctgagcgtctgtctcggtgtcctggtcgtgtttatggtgctgcagtcgatctacatattccagcacgtgcaccacttcgccatgatctgcgatgccataccgacgctggtcgtctgcatggtggctatttccaagttctacatcttcgttttccacccggccgccctgttcgcgctgattgattcgttcaaagcgctgcagcggcgggctagcagggaggacttgctgctgtttcggcgcagcggagcgtttcatgcgaagctgacgaaaatctacatgacatcggcactgattgtgggttggttctacatactaagtgccatcgtctcaggaatctcgcggtcattggcggaaggacgggttcattttgtagcaccgatggcctttccccacaactatcagcatccgctcatgtttgcgttaacgttcctgttcaactgtgactccatacacatgagcatcttcattagcggaagtgtcgatacgtgcttttccgagctggcgacgagcgttacgatccactttcagctcatccaacgccagttccaggcagttgactttgcggctcgtaccgccgaagacgaactggaggtcgtcgtggcgtaccataaggatgtgctgcagttgtgcctggccatgacgaacctcttccagtacaccgtgttctacctattgctgctagactcggtgctgctctgcgtgattggctatcaatttgtgatattcatgaacacgccgcgtgtccttatgctggcgtcgatggcgttcgttatggttttacaagcggtcatatattgttaccacggttccatgatgtacgatgagagcttgaaggtggcggacgcgatttaccagagcaattggtacgaggctccaccggcggtacagaagcggctgcgattatgtatcatgcgagcccagaagcctatcgtcaccaaaggtggcttcataaaggccaccctgcccacactgaagaagattttaaactcaacgggatcatacatcactatgctgctctccttagagacagagcagtag

SEQ ID NO: 71 - protein, 407 aa, Anopheles gambiae
MQTGGVLSRMRRALGRFYVERDFFRPYEILLALPGFHLVEEFRTSSWKRALFLLSRTVQLLQYALWADRFYLALVDPSSPPGKALHYGNTFGVLTMMLARMLVVRWYLPHVRQLMEYLRRQRGRIEPAPDTHRLSYRRIVNIAITFQLIGLADRLVAGFSQTYRQELYEVPANLAELQWPMVVAVHVLSFDFASRWGAAYNVSLTGMNSIMMGLYDELTSIAQEYGRLLTKEKNGQADIWTSFERNTARAVRRHETFLWQLGQLKPFLQTTFLVMFYSAALFLAIGTFMISANGTTTYGVILSGFLFALLLECYWCCQLVDRLNEVNTQIGILLYSLDWPVELQYTKATASRYRQARSSLLIMMSKTQKSLGIRCGGMFEMSSEAFASLVKLTYTMLMFLRDTQKPN

SEQ ID NO: 72 - DNA, 1224 bp, Anopheles gambiae
atgcagaccggtggcgtgctgtcgcgcatgaggcgtgccctggggcgcttttacgtggagcgtgattttttccgcccctacgagatactgctcgccctgccgggctttcatctggtggaagagtttcggacgagtagctggaagcgggcgctgttcctgctgtcgcgcacggtgcagctgctgcagtacgccctgtgggccgatcggttctatctggcgctggtggatccgtccagcccgcccggaaaggccctgcactacggcaacacgttcggcgtgctgacgatgatgctggcccgcatgctggtggtgcgctggtatctaccgcacgtgcggcagctgatggagtatctgcgcagacagcggggtcgcatcgagccggcacccgatacgcaccggctgtcctatcgccggatcgtcaacatagccatcaccttccagctgatcgggctggcggatcggctagtggctgggttctcgcagacgtaccggcaggagctgtacgaggtaccggcgaatctagccgagctccaatggccgatggtggtggcggtgcacgtactttcgtttgactttgcgagccgctggggcgccgcgtacaacgtgtcgctgacgggcatgaactcgatcatgatgggactgtacgacgagctgacgagcatcgcgcaggagtacggtcgactgcttacgaaggagaagaacggtcaagcggacatctggacgtcctttgagcgtaacacggcgcgtgcggttcggcggcacgagacgttcctgtggcagctgggacagttgaaaccgttcctgcagaccacgttcctggtgatgttctactccgcggcgctatttctcgccatcggcaccttcatgatctcggccaacgggacgacgacgtacggtgtcattctgagcgggttcctgtttgcattgttgctcgagtgctactggtgttgtcagctggtcgatcggctcaatgaagtgaacacacaaattggaattctgctctacagcctggactggccggtggagctgcagtatacgaaggcgaccgcaagccgctatcggcaggcccgctcctcgctgctgatcatgatgagtaagacgcagaagtcgctcggcattcgatgcggcggcatgttcgagatgtctagtgaagcgttcgccagccttgtgaagctaacctacaccatgctgatgtttttgcgcgacacacaaaagccgaattaa

SEQ ID NO: 73 - protein, 393 aa, Anopheles gambiae
MEAEKQDTPTSDDPYRWGDYIRPVRITVWTWKICGLYNGKPQTTRYRVYRAVFNIFLMVVYLFTLSLNVFVMQTFEQLVLYIMYIVFTEIVMALKAIVTYYKFDQLCDLYRQTLGSDFKPLDAEEEQLHRKGVASINRYLYPYLVTTNLAVASSCLYLLQDDYRLPYFPWILGIEYGPTKRLNYGLLFAYQVIGMYLHMLINVAIDVQLSYLLGMISIQLDLIGKRFRSLHTSEQFRESFVGLMNHHGKVQRMTAEIEQLFSAAYFAQFGSSGLVICASAFKTSSMFNLYELTAIQNLLYMLSMIFQMFLPCRFGNEVTRKSHLLRTSIYSSRWYEMGLQERKTLRMLLQRMNKPLTLKAFYFFNYNLQAFTTTLNMAYSLYALLQRNALKKV

SEQ ID NO: 74 - DNA, 1182 bp, Anopheles gambiae
atggaggccgaaaagcaggatacacctaccagcgatgatccgtaccgttggggcgactacatacgccccgtcaggataaccgtgtggacctggaaaatctgtggtctttacaatgggaagccacagacaacacggtaccgtgtgtaccgtgccgtgttcaacatcttcctgatggtagtgtacctgttcacgctgtcgctcaacgtgttcgtgatgcaaacgttcgagcagctggttctgtacatcatgtacatcgtgtttacggagattgtcatggcactgaaggcgatcgtcacctactacaagttcgatcagctgtgtgacctgtaccgccagacgctcggcagtgactttaaaccgctcgacgccgaagaagaacagctgcaccgcaagggagttgcaagtattaaccgctatctgtatccgtacctcgtgacgacgaacttggccgtcgccagttcgtgcctgtacctgctgcaggacgattacaggctgccctactttccctggatactgggcatcgagtatgggccgacgaagcgtcttaactatgggctgctgtttgcttaccaggtgatcggcatgtatctgcacatgctgatcaatgtagcgatcgacgtgcagctgtcctatctgctcgggatgatcagcatccagctggatttgattggcaaacgtttccgctcactgcacacgtccgaacagttccgggagtctttcgtcggcttaatgaaccaccatggaaaagtgcaacggatgaccgctgaaatcgagcagctcttctcggcggcatactttgcccagttcgggtcgagtgggttggtgatttgtgcgtccgcattcaagacatcttcaatgtttaacctgtacgagctgaccgccatccagaacctgctctacatgctgtcgatgatatttcaaatgttcttaccatgtcgcttcggcaatgaggtgacgcgcaaaagccacctgcttcggacctccatctacagctcccgttggtacgagatgggattgcaggagcgcaaaacgttgcgtatgttgctgcagcgcatgaacaaaccgctcacgctgaaggcgttctattttttcaactacaatctacaggcgtttactacgacactcaatatggcctattcattgtacgcattgttgcaacgcaacgcattgaagaaagtttaa

SEQ ID NO: 75 - protein, 407 aa, Anopheles gambiae
MIITVAPVTDARPQTPEDCGMFKFQRKILLIFGCWPPDRLTRRWYVKVLIAVNLITLAICIVGEFRYCLYAYRNGSLIETIESICPTVARFSGLLRMCWFLRNEHKIKSALNSVVHLIKNEHPRETGYTNRITARDQTITKVLFHSSFITAILYGIIPYFMMAYNWFQGQYPLVKLLPFKVVLPFDSQDPTLFVLTTIFLNYASVPTITAMTSTDALFSGVCLYMDGQFQAIRLELEALAETVDKYTLKSSAAETLRINLELRRINKRHQTIIDVVSEVRHAFTPTILIVHICAAFMICVISMAMFLAEGINKLTYMPYTFTVLMLLFMYSYGGTVVRESSEAIQTVAYGFPWYQFDRNTRHLVQMMMVRAKYGCNVDVPFFRTSMATFSVIVRSAMSYITLMKSFL

SEQ ID NO: 76 - DNA, 1224 bp, Anopheles gambiae
atgattattaccgttgctccagttacggacgctcgccctcaaacgcctgaagactgcggcatgttcaagttccagcgtaagatcctgctcatcttcggctgttggccaccggatcggcttacacgtcgctggtatgtgaaggttctcatcgccgtcaatctgatcacgcttgccatctgcatagtgggcgagtttcggtactgcctgtacgcgtatcggaacggtagtctgatcgaaacgatcgaaagcatttgcccaactgttgccagattttctggcttattgcgtatgtgctggtttcttaggaacgagcataaaattaaaagcgctctaaacagtgtcgtccatttaattaagaatgaacatccacgtgaaactggctacacgaatcggatcacggcccgagatcaaacgataactaaagttcttttccattcaagtttcataactgcgatactgtatggcatcataccatactttatgatggcttacaactggttccagggccagtatcctcttgtgaagcttttaccgttcaaagttgtgctacccttcgactcacaagatcccacgctctttgtactgacgacaattttcctcaactatgcttcggtacctaccattacggccatgacgagcactgacgcattgttcagtggagtttgcctttacatggatggccagtttcaagcgatccggctggagttggaagcactcgccgaaacggtagacaagtacacgctgaaaagctccgctgctgaaacgcttcgcatcaatctcgagctgaggcgcatcaacaagcgccatcagacgattattgacgtcgtgtcggaagtacgccacgcattcaccccaacgattctgatcgtgcacatctgtgcggcgttcatgatatgtgttataagcatggcaatgtttctagccgaaggaatcaacaagctcacctacatgccgtacacgtttacagtgctgatgttgctttttatgtactcgtacggtggcacggttgtgcgagaatcgagtgaagccatccaaacagtggcctacggtttcccgtggtatcagttcgatcgtaacacccgacacctcgtccagatgatgatggtacgggcaaagtatggatgcaatgtggacgtaccgttttttcaaacgtcgatggctaccttctcggtgatcgtacgctcagctatgtcatacatcacgttgatgaagtcgtttttgtag

SEQ ID NO: 77 - protein, 408 aa, Anopheles gambiae
MVSFGAAASNPRDAETTPHWDIFKLQRKILLIFGVWPADRLVRPWYVKVLIAINLATLAICMVGEFLHGLYAYQEGDLSESIESICPTVARISGFLRMVFYLANEEKIHRVLNNISKTLQDEHPREHTITKQLTTLGQQFTFYLFLMMFFAACLYGVTPFFIMIYNWVQGQRPLVKLLPFKLALPFDSQNLFPFVVTTLFLNYASAPTITSQSGSDALFSGVCLYIYGQFQAIRLEVEALAETVDRNTLKSSAAETHRINLELRRISKRHQAIIDLVSEVRSAFTPNVLLVYTATAIIMCIVCIAMLVVEGIYKLTYLPYAFAELTLLFLYSYSGTIIRDSSEAVQTVAYDFPWYRYDRNTRHLIQMMMIRAQYGSNVDVPFFETSMASFSAIVRTASSYITLMKSFL

SEQ ID NO: 78 - DNA, 1227 bp, Anopheles gambiae
atggtgtcgtttggtgctgcagcttctaatccacgggacgcggaaactacgccacactgggacatcttcaagctgcagcgaaagatcctgctcatctttggagtctggccagcggatcggttggtgcgcccgtggtatgtgaaggtgctgattgccatcaatctggcaacgcttgccatctgcatggtgggtgagtttctgcacgggctgtacgcttaccaggagggcgacctgagcgaatcgatcgaaagcatctgcccaacggtggcgcgaatatcgggctttctacggatggtgttttatcttgctaatgaggagaaaatccaccgcgtgctgaacaacatcagcaagacgctgcaagacgagcatccgcgggagcacaccatcaccaaacagctgacaacgctggggcaacagtttaccttctacctatttctgatgatgttttttgccgcatgtctctacggagttacacccttttttatcatgatctacaattgggtccagggacagaggccgctcgtcaagcttctgccgtttaagttggccttgccctttgattcccagaacctttttccctttgtcgtaaccacactattcctgaactacgcctcggcacccaccataacctcgcagtcgggcagcgatgcactcttcagtggagtttgcctctacatttacggtcagtttcaagcgatccggctggaggtggaagcactcgccgaaacggtggacaggaacacgctgaaaagctccgcagctgaaacgcatcgcatcaatctcgagctgagacgcatcagtaagcgccatcaggcaatcattgaccttgtgtcggaggtgcggtccgcctttacgccgaatgtgctgctcgtctacacggccaccgcgatcatcatgtgcatcgtgtgcatcgccatgcttgtggtggaaggaatctacaagctcacctacctgccgtacgcgtttgccgagctgacgttactgtttctctactcgtacagcggcacaatcatccgcgattcgagtgaagccgtgcagacggtagcgtacgatttcccgtggtaccggtacgaccgcaacactcgccatcttatacaaatgatgatgattagggcgcagtacggatcgaacgttgatgtgcctttcttcgaaacctcgatggcaagcttttcggcgatcgttcgtacagcttcatcgtacatcacactgatgaagtcctttttgtaa

SEQ ID NO: 79 - protein, 454 aa, Anopheles gambiae
MLRPTSEDDQTLLINFRLLERVLRLMAVWPTDFNPYLPQYLRGRFFLSELFDFGYQLFWYFICVHIAAFHIMSVLTGDLSYDELFLTLITTSIYSILVPLSLYLRLYESNIRQLYEFSQRHFRKRSAAGVHYISISSSYRFTNKYQFWWIASCLLGTMHWAVYPILSQERTLPFPCWYPVDVHESPMYELAYIFQVLGQLQVSLVFGLASALFMVFVFVVCTQFDMLCCSLSNVRQSAMILNGGYGPELRDYQDNYELDTRDYVLQEVFREDLDTVQGTKTASRLDQLSPAQSYLMELAPELTCVMEDCIQHHLILLRFCQLLENCYHPYVLLKLLQILLLLCFLSFMATVESLSTMKLINVLEYFMLSITELYLYCFLGQTLKNQGLKVGDALWKSPWHLCGASYRRRLVIILMNAQRPVRLTGLKLYELNLETYYTVLKAAFSYYTIIKKFR

SEQ ID NO: 80 - DNA, 1365 bp, Anopheles gambiae
atgttgcgaccgaccagtgaggacgaccagacgctgctgataaacttccgcctgctcgaacgcgtgctgcggcttatggcggtgtggccgacggatttcaatccctacctgccgcagtacctgcgcggtcggttcttcctttccgagctgttcgatttcggctaccagctgttctggtactttatctgcgtgcacatcgcggcctttcacatcatgtcggtgctgacgggcgaccttagctacgacgagctgttcctcacgctgatcactaccagcatctactcgatcctggtgccgctgagtctgtatctgcgcctgtacgaaagcaacatccggcagctgtacgagtttagccagcgccatttccgtaaacgttcggccgccggtgtgcactacatatcgatcagctccagctaccggttcaccaacaagtaccagttctggtggatcgcctcctgcctgctcggcacgatgcactgggcggtctatccgatactgtcgcaggagcgtacgctaccgtttccctgctggtacccggtggacgtgcatgagtcaccgatgtacgagctggcgtacatcttccaggtgctggggcagctgcaggtcagcctggtgtttgggttggccagtgccctgtttatggtgtttgtgtttgtggtgtgcacgcagttcgatatgctgtgttgcagcctctcgaatgtgcgccagtcggccatgatactgaacggtggatatgggccggagctgcgcgattatcaagacaactatgagctcgatacgcgcgactacgtcctgcaggaagtgttccgcgaagatctggacacggtgcaaggcaccaaaacggcatccaggctcgatcagctgagtcccgctcaaagttatctgatggaacttgcccctgaactgacctgcgtgatggaggactgcattcagcatcatctgatattgctgcgcttctgtcagctgctcgaaaactgctaccatccttacgtcctgctgaagttgcttcaaattctactgctcctttgctttctctccttcatggcaacggtggaaagtttgtcgacgatgaagttaattaacgtgctcgagtacttcatgctctcgataacggaactgtatctgtactgctttcttggtcagaccctcaagaaccagggcttgaaggtgggtgacgcactgtggaagtctccgtggcatctgtgtggagcttcctaccgacgccggctgttgataatcctgatgaatgctcaacgaccggtacggttgactggtttgaagctgtacgaactgaacctggaaacgtattacacggtactcaaggctgccttctcgtactacaccatcattaaaaagtttcgctaa

SEQ ID NO: 81 - protein, 382 aa, Anopheles gambiae
MSEHPIHTFDRLIKRQRLLLKLIGIDSYDPAFRIHSLTFMLVCLALTFFVISLYDLYLFRDDLFNFVYVLITIFFATIGIGHISVFLLCSKLLAELLEQSYRTYRLVVDDQREQRILQWYTRLFQRAVDGYTLVFIGTSVAAGLLPLAIYLLSGDRVLPYGVVLPFVDPDSLVGYELNYIYQVSCIIWTPPGLVASVCMLFGLVLNICIQYDILAVKLQDLDELIRSPHPHRDAMIGCKLRSILRNQQRLIRFIANIEAAKNVHSAVEVLSLGLQIVITLFVLQFSLWIPGLVLIPVFTMQLFLFCLLGTIIEDKGVKFSAGVYSLTWNELSKQDKQIFRLLLLSSQQPQTLTCAGMTCISLNLFVNMSQKFYSIFMMLRNM

SEQ ID NO: 82 - DNA, 1149 bp, Anopheles gambiae
atgtcggagcatccgatacacaccttcgatcggctgatcaaacggcagcgcctgctgctgaagctgatcggcatcgatagctacgatccggcgttccgcatccactcgctcaccttcatgttggtgtgcctggcgctcaccttcttcgtcatctcgctgtacgacctgtacctgttccgggacgacctgttcaactttgtctacgtgctgatcacgatcttcttcgcgacgatcggcatcggccacatatcggtgttcctgctgtgcagcaagctgttggcggagctgctggagcaatcctaccgcacctaccggctggtggtggacgatcagcgcgagcagcgcatcctgcagtggtacaccaggctgttccagcgggctgtggacggctacacgctcgtctttatcggcacgtccgtggcggccggcttgctaccgctcgccatctacctgctgtccggcgaccgggtcctgccgtacggtgttgtgctgccgttcgtcgaccccgactcgctggtgggctacgagctgaactacatctaccaggtgagctgcatcatctggacgccgcctgggctggtcgcgtcggtatgcatgttgtttgggctcgtgctgaacatctgcatacagtacgacatactggcggtgaagctgcaggacctggacgagctgatacggtcgccgcacccgcacagggacgcgatgattgggtgcaagctgcgcagcatccttcgcaatcagcaacgactgatcagtttcatcgccaacatcgaagcggcaaaaaacgtccattcggccgtggaggtactctcgctagggctgcagatcgttatcacactgttcgtattgcaattctcactctggatccccgggctggtgttgataccggtcttcacaatgcagctctttctgttctgcctgctcggtaccatcatcgaggataagggcgtcaagttttcggccggcgtgtatagcctcacctggaacgagctgtccaagcaggacaagcagatctttcgcctgctgctgctgagctcacagcagccccagacgctcacctgcgctggtatgacctgcatcagcctgaacctgttcgtcaatatgtcgcaaaagttctactcaatcttcatgatgttacgcaacatgtaa

SEQ ID NO: 83 - protein, 387 aa, Anopheles gambiae
METHIGKQHSLERFQAMVAWQNRVLALFGCYMYLGKERVSYRIVPICFMACSFVLLSLYSAVQARGNMGQAVLSIVVLFYGIVGVTRLAVAISNPAGCYRSIQIAEEMYQRANGSNPAECNVLAKYTDLFCKSVQLYTVCFVLSVVVLTLMPFALYLLRGERYLPLGIVLPFTAETDDFGFWCTLVVQLAYMYTGPFGLIPSQNIYFAFVFNICLQYELLIERLKQLDERIRSSNNLKLTVRDQLVKIIQLQQESTKYITHIERFYQLQSFVEFLCNSLQVALTLNELHRNFWLPGLFILPIAVMQMLILCSLGTLIELKSDQFKDQLYDIAWPEMDLPEQGMFKYVLKSAQQPKQLTCGRFAVINMNLFLAIHKKIYSFFMMLQNM

SEQ ID NO: 84 - DNA, 1164 bp, Anopheles gambiae
atggaaacccatatcggaaagcaacattcgctggaacgcttccaagcgatggtagcttggcaaaaccgtgtactggccctgttcggatgctacatgtatctcggcaaagagcgagtgtcttaccgcatcgtgccgatctgctttatggcctgctccttcgtcttgctgtcgctgtacagtgcgatccaagccaggggcaatatgggtctggctgtgctgagcattgtggtcctcttctatggcatcatcggtgtgacacggttggcggtagcgatcagcaatccggccggttgctaccgatcgattcagatcgccgaggagatgtaccagcgtgccaacggatcaaatccggcggaatgcaatgttctggcgaagtacaccgacctgttctgcaaaagtgtgcaactgtacaccgtctgctttgtgctgagcgtggtagtgcttacgctgatgccctttgcactatatctactgcgtggcgagcgttacttgccgctagggatcgtgctaccctttactgctgaaacggatgatttcgggttttggtgcacactcgtcgtgcagctggcgtacatgtacacaggtccttttgggctgattccgtcccagaacatatactttgcgtttgtgtttaacatttgcctgcagtacgagctgctgattgagcggttgaagcagttggatgaaaggattcgaagctccaacaacctgaagctgaccgtgcgcgatcagttggtgaagatcattcagcttcagcaagagtctacaaactacattacacacattgagcgcttttatcagctgcaatcgttcgtggagtttctgtgcaactcgctgcaggttgcgctgacgttgaacgaactgcatcgtaacttttggttgccaggattgttcatactaccgattgcagtgatgcagatgcttatcctatgctctttggggacgctgattgagctgaaaagcgatcagttcaaggatcagctgtacgatatagcctggcccgagatggacctaccggaacagggcatgttcaagtacgtgctgaaaagtgcgcagcaacctaaacaactgacgtgtggtcggttcgccgttatcaatatgaacctgtttctagcgattcacaaaaagatttactcattctttatgatgctgcaaaacatgtag

SEQ ID NO: 85 - protein, 386 aa, Anopheles gambiae
MTFTLSHDLYVYNLHLIRWFASFVGLDIMAPNYKPNILTFLAFFGLSISLIGEVYTVWYFWPILDKLMESAAIFGVFIQGLAKFYTALRYRKFFEAMYNRLDLFHYEYRNHEKNNATLLLLMNRICLLRKLITSQFSISILTLMVTPVAQYILKGERFLVYTIILPFTDPEITSHYLLNLVVQYYLLIVGLAGFSAAENVLILFVTSVAGYADVLKNKINEMNTLLLDAQNSRDRTSVKLKLREIVLLHQRVLEYEDDLDKRYYLNNWVQVASSIFNLTGALFGCYVSNSFTMYALAITIVIQLFELCLLGTILSIKNEEIEHAFYDSLWYLMDHSEKKDFLIMFHKCQHAKEMTVASMAPLNIVLFIAIMQKIYALAMMMMRFSE

SEQ ID NO: 86 - DNA, 1161 bp, Anopheles gambiae
atgacgtttactttgtcgcacgatttatacgtttacaaccttcacttaatccggtggttcgcttcatttgtcggccttgatataatggctccgaactataaaccgaacattcttacctttctggcattttttggactatcaatctcgctaatcggtgaggtatacaccgtttggtacttctggcctattttagacaagctaatggaatctgcagccatctttggtgtcttcatacagggtcttgcaaagttctatatagctcttcgttatcgcaagttctttgaagccatgtacaaccgtttagatctattccattacgaatatcggaaccatgaaaagaataatgcaactcttctcttactaatgaatcgtatctgcttgctgaggaaacttattacatcacaattttctatctcaatcctaacattaatggttactcccgtggctcaatacatcctgaagggtgagcggtttctggtgtacaccattattttgcctttcaccgatccggagataacatcacactacctactgaatctagttgttcagtactatctcctaattgtaggattggctgggttttcagctgctgagagtgtgttgatactttttgtgaccagcgttgctggatatgccgatgtgctcaaaaataagatcaatgaaatgaacactttattgctggatgcacagaattcccgtgaccgtacgtcagtcaagttaaagctacgtgagattgttttgctacatcagcgtgttttggagtacgaagatgatcttgacaagcgttactatctcaacaactgggttcaggtggcctcaagtattttcaatctcactggtgcattgtttggttgctacgtcagcaatagttttaccatgtacgcattagcgatcactattgtaattcaactgtttgagctatgtctgctaggaactatcctcagtataaagaatgaagagatcgagcatgcattctatgattctttgtggtatctgatggatcattctgagaaaaaggactttttaatcatgtttcacaaatgccaacatgccaaggaaatgactgttgccagtatggcgccgctgaatatcgttctttttattgctataatgcaaaagatctacgccttagccatgatgatgatgaggttttcagagtga

SEQ ID NO: 87 - protein, 386 aa, Anopheles gambiae
MTFTLSHDLYVYNLHLIRWFASFVGLDIMAPNYKPNILTFLAFFGLSISLIGEVYTVWYYWPNLVKLMESAAVYGVFIQGLAKFYTALRYRKFFEAMYNRLDLFHYEYRNHEKNNATLLLLMNRICLLRKFITLQIIGCILVLSLNPVIQYIIKRERVLVYAILLPFSDPEITSHYLLNLIVQYYLMIAGIGGFAAAESVLILFVTSVAGYADVLKNKIDEMNIILLDAQNSRDRTPVKLKLREIVLLHQRVLEYEDDLEKRYYLNNWVQVASSIFNLTGALFGCYVSNSFTMYALAIAVVVQLFELCLLGTILSIKNEEIEHAFYDSLWYLMDHSEKKDFLIMFHKSQHAMEMTVASMAPLNIVLFIAIMQKIYAYAMMLMNFFE

SEQ ID NO: 88 - DNA, 1161 bp, Anopheles gambiae
atgacgtttactttgtcgcacgatttatacgtttacaaccttcacttaatccggtggttcgcttcatttgtcggccttgatataatggctccgaactataaaccgaacattcttacctttctggcattttttggactatcaatctcgctaatcggtgaggtatataccgtttggtactattggcctaacttagttaagttgatggaatctgcagccgtctatggtgtcttcatacagggtcttgcaaaattctacacagctcttcgttatcgcaagttctttgaagccatgtacaaccgtttagatctattccattacgaatatcggaaccatgaaaagaataatgcaactcttctcttactaatgaatcgtatctgcttgctgaggaaatttatcacattacaaattattggttgcatcctagtcctgtctcttaatccagtcattcaatacatcatcaagcgcgaacgtgttctagtttacgctattcttctgcccttctctgatccggagataacatcacactacctactgaatctgattgttcagtactatcttatgattgctggaattggaggatttgcagctgctgagagtgtgttgatactttttgtgaccagcgttgctggatatgccgatgtgctcaaaaataagatcgatgaaatgaacattatattgttggatgcacagaactcccgtgatcgtacgccagtcaagttaaagctacgtgagattgttttgctacatcagcgtgttttggagtacgaagatgatcttgaaaagcgttactatctcaacaactgggttcaggtggcctcaagtattttcaatctcactggtgcattgtttggttgctacgtcagcaatagctttaccatgtacgcactggcgatcgctgttgtagttcaactgtttgagctatgtctgctaggaactatcctcagcattaagaacgaggagatcgagcatgcattctatgattctttgtggtatctgatggatcattctgagaaaaaggactttttaatcatgtttcacaaaagccaacatgccatggaaatgaccgttgccagcatggcgccgctcaatatcgttctttttattgctataatgcaaaagatctatgcttatgccatgatgttgatgaacttcttcgagtga

SEQ ID NO: 89 - protein, 383 aa, Anopheles gambiae
MPRATSNSAANLERLVIRISSHMAVLKLNIIDPAWRPTLRFGIVLFLTALVPVYIWQGIKVYRTRFETLLEVLSVAGCGWQMFFRMYFYLFQQDRCRQIVQEVRDQRTVYGADRNPRMEKLFRAGTKRMLLAYRVIHLMYGTSYFFQLGPLIMPDPHKCNLPLALQLPFLPPDRNMVYYCINYAHHLLLNTIGVFILLPMDGVLIVALLNICTRIAALQLLLEELDAKLGTVQWQQTAHLDAELNRIIELHIDTKRFARVIYETYQMHFFSMFSVLCFVICMCMNVVARDPRSTLIPFGLASTGQLFVICMLGNVLYIVSDRLKDSVYGIRWYRCTVSQQKRLMFLLANAQPEIVMGAVFIPVTMTSFVTIIRAAYSYFTILY

SEQ ID NO: 90 - DNA, 1152 bp, Anopheles gambiae
atgccacgtgcaacgagcaacagtgcagccaacttggaacggctggtgatacgcatctccagccacatggcggtgctgaagcttaacatcatagacccggcctggcgcccgaccctgcgcttcggtatcgtactgttccttaccgccctcgtaccggtgtatatctggcaggggatcaaggtgtaccggacacggttcgaaaccctgctagaggtcctgtctgtcgccggttgcggctggcagatgttcttccgcatgtacttctacctgttccagcaagaccgctgccggcagattgtgcaggaagtgcgcgaccagcggaccgtgtacggtgctgatcgaaatccccgcatggagaagttgttccgggctggcacgaagcgtatgctgttggcgtaccgcgtcatacatctgatgtacgggacgtcttacttctttcagctgggtccgctgatcatgcccgatccgcacaagtgcaacctgccgttggcgttgcaattgccctttttaccaccggatcgaaatatggtctactactgcatcaactacgcgcatcacttgctgctcaacacgatcggtgtctttatcttgctgccgatggatggtgtgctgatcgtggcactgctgaacatctgtacgcgtatcgctgccctgcagctactgctggaggagctggatgcgaagctcgggaccgtgcaatggcagcaaacggcccatctcgacgccgagctgaaccgcatcatcgagctgcacatcgacacgaagcgcttcgcgcgcgtcatctacgaaacgtaccagatgcactttttctccatgttcagcgtgctgtgtttcgtgatctgcatgtgcatgaatgtggtcgcccgggacccgcgcagtacgctgataccctttgggctcgcctcgacgggccagctgtttgtgatctgcatgctgggtaacgtgctgtacatcgttagcgatcggctgaaggacagtgtgtacggtattcgctggtaccggtgcacggtttcgcagcagaagaggctcatgtttctgctggccaatgcacagccggaaattgtcatgggtgcggtgtttataccggttacgatgacatcgttcgtgacgatcatccgagcggcctattcttactttaccatactttattga

SEQ ID NO: 91 - protein, 387 aa, Anopheles gambiae
MVVFEPLDDPLKVLPLPLKLLALLGVNKNPSERFRLYAIYIYLWVAMFIPKLCLGYETIPQCFRSIAEGMFSFNTTVTFIMLPLKMDNFEGLLQNLQRFTQIVTVEEDYKQILISLNTTIHKFTKFYFIFTNGVVFSITGSTIAGMLYTYYTKDSEYSAAFPLVMENRFYVLDSHYNLGHCFVHQALMFFALYILLVMFTAKAGTLFGLIRFCSTVLGIIVLKIERLSQIGPVDQYTAELSEIIELHQLVIKCSRQLQNILMEILLAQFTGCVFIWCFMLYYVMISGITAEGIAVGAMLIALSTETFIFCLLGNELTLKGLEISTAMYSTNWYDQPVKLQKMVVPIIQQSQQRIGITAAKFYYIDYNRYGQSLKTAYSFYLLLKDIF

SEQ ID NO: 92 - DNA, 1164 bp, Anopheles gambiae
atggttgtgttcgaaccactggacgaccctttgaaggttctgccactgcctcttaaacttctggcactgctcggagtgaacaagaacccgtccgaacggttccgtctttacgccatatacatttacttgtgggtggcgatgttcataccgaaactctgcctgggatacgaaaccattcctcaatgcttccgaagcatcgccgagggtatgttttcgttcaacactaccgtcaccttcattatgttgcccctaaagatggacaacttcgaaggcttgcttcaaaatctacagcgttttacccaaatcgttacagtcgaagaagactacaaacaaattctaatcagcctcaacacgacaatacataagttcaccaagttttacttcatcttcacaaatggggtcgtgttttccattaccggcagcacgatagcaggaatgctctatacctactacacgaaagattcggaatattccgcagcatttccgctcgtaatggaaaaccgtttctacgtgctggattcgcattacaacctaggccactgttttgtacatcaggctctgatgttctttgccctctacatcctgttggtaatgttcaccgccaaggccggtacgcttttcggtttgattcgcttctgttcgaccgtgctgggaatcattgtcctcaagatcgagcgactgagccagatcggacccgttgaccagtatactgcagagctgagtgaaattatcgaacttcaccagctggtgatcaagtgttcccgccagctgcagaacattctgatggaaatcctgttggcccaatttactggctgcgtgtttatatggtgctttatgctgtattatgttatgataagtggaataactgctgaaggtattgccgtgggagccatgctcatcgccttatctacggaaacgttcatcttttgcttgttggggaacgagctgacgttgaagggtcttgaaattagtacggctatgtattccaccaattggtacgatcaaccggtcaagctacagaagatggttgtaccaataatacagcaaagccaacagcgaatcggtataactgcggccaagttttactacatcgattacaacagatacggacaaagcctgaaaaccgcctactctttctatcttctgctgaaggacattttctag

SEQ ID NO: 93 - protein, 387 aa, Anopheles gambiae
MVVFDPLDDPLKVLPLPLKLLALLGVNKNPSERFRLYAIYAYLCIALFIPKLCLGYETILQCFRSIAEGMLSFNTTITFIMLPLKMDNLEDLLKNLKRFTEIVIFNEDYEQILIRLNTAIHKFTKYYFIFTNGIVFAMTSSTIAGMFYTYYAKDSEYSAAFPLIMENRLYLIDSHYNLGHCFVHQALMFFALYILLVMFTAKAGTLFGLIRFCSTVLGIIVLKIERLSQIGPVDKYTAELNEIIELHQLAIKCSRQLQNILMEILLAQFTGCVFIWCFMLYYVMISGITAEGIAVVAMLIALSTETFIFCLLGNELTLKGLEISTAMYFTNWYDQPVKLQKMVVPIIQQSQQRIGITAAKFYYIDYNRYGQSLKTAYSFYLLLKDIF

SEQ ID NO: 94 - DNA, 1164 bp, Anopheles gambiae
atggttgtgttcgatccactggacgaccctttgaaggttctgccactgcctcttaaacttctggcactactcggagtgaacaagaacccgtccgaacggttccgtctgtacgccatctacgcctacctttgcattgcgttgttcatacctaaactctgcctgggatacgaaaccattcttcaatgcttccgaagcatcgccgagggtatgttatcgttcaacactaccatcaccttcattatgttgcccctaaagatggacaacttggaagacttgcttaaaaatctaaagcgttttaccgaaatcgttatcttcaatgaagactacgaacagatcctgattagactcaacacggcaatacataagttcaccaagtattacttcatttttacaaatgggatcgtgttcgccatgaccagcagcacgattgcaggaatgttttacacctactacgcgaaagattcggaatattccgcagcatttccgctcataatggaaaatcgtctctacttgatagactcgcactacaaccttggccactgtttcgtgcatcaggctctgatgttctttgcgctctacatcctgttggtaatgttcaccgcaaaggccggtacgcttttcggtttgattcgcttctgttcgaccgtgctgggaatcattgtcctcaagatcgagcgactgagccagatcggacccgttgacaagtatactgcagagctgaatgaaattatcgaacttcaccagctggcgatcaagtgttcccgccagctgcagaacattctaatggaaatcctgttggctcaatttactggctgcgtgtttatatggtgctttatgctgtattatgttatgataagtggaataactgctgaaggtattgccgtggtagccatgcttatcgccttatcaacggaaacgttcatcttttgcttgttggggaacgaactgactttgaagggtcttgaaattagtacagctatgtacttcaccaattggtacgatcaaccggtcaagctacagaagatggttgtaccaataatacagcaaagccaacagcgaatcggtataactgcggccaagttttactacatcgattacaacagatacggacaaagcctgaaaaccgcctactctttctatcttctgctgaaggacattttctag

SEQ ID NO: 95 - protein, 397 aa, Anopheles gambiae
MVNLFARTPADNFRVMPYNLRLFAMLGLWGDRRKLYRLYALLLLAYVAIIFPKPVRITDRHPFESIVRSVSELIFAALCYLTIIILAIKSEPFRAVIRKMEQALELFRDKQDQCSQLIIEVNANIHRFSLGYAKLNLLYVLLFNVIPPIYNYPRYFLQWRMPEDNRTVEFMLPLMQDLYGLDVHHNIVHYTISWVAITPFCVFCALILWFKGALFMLIRYNTLLYQLVNRLLQQYDRESAGGLLAQKHRRLQQIVQLHYRAIECTKLLDSILSLILLIQCVGCLLMLCLMLFYITRNHSLNVINIAVLLMSIFIEMMCFSYLGNQLTEENANISHSAFNCRWYDEPIVIRKYFLRIILQAHRKATITAGKFYNVNIVTFAQLIKTSYTYYMIMKEMF

SEQ ID NO: 96 - DNA, 1194 bp, Anopheles gambiae
atggtaaaccttttcgcccggacgccggccgacaacttccgcgtgatgccgtacaatctgcgcctgttcgcgatgctcggcctgtggggcgaccggcgcaagctgtaccggctgtacgcgctgctgctgcttgcgtacgtggccatcatcttcccgaagccggtgcgcatcaccgaccggcacccgttcgagtcgattgtgcgaagcgtgtccgagctgatctttgccgcgctctgctacctgacaatcatcatcctggccatcaagtcggaaccgttccgggcggtgattcgcaagatggagcaggcactggagctgtttcgcgacaagcaggaccagtgcagtcagctgatcatcgaggtgaacgctaacattcatcggtttagcctcggctacgccaagttgaacctgctgtacgtactgctgttcaatgtaattccaccgatctacaactatccgcgctacttcctccagtggcgcatgccggaggacaaccggacggtcgagttcatgctgcccctcatgcaggatctgtacgggttggatgtacatcacaacatcgtgcactacaccatctcttgggtggccatcacaccgttctgtgtgttctgtgcgcttatcctctggttcaagggtgcactgtttatgctgatccgctacaacacactgctctatcagctcgtcaaccggctgctgcagcagtacgatcgtgagtcggccgggggacttttggcgcagaagcaccgccggctgcagcaaattgtccagctgcactaccgtgcgatcgagtgtaccaagctgctggacagcatcctgagcctgatactgctgatccagtgtgtcgggtgtttgctgatgctctgcctgatgctgttctacatcacgcgcaaccacagcttgaacgtgatcaacattgcagtgctgctgatgtccatcttcatcgagatgatgtgcttctcctacctgggaaaccagctcacggaagagaatgctaacatcagccattccgccttcaactgccgctggtacgacgagccgatcgtgatacggaagtactttctgcgcatcatcctgcaggcccaccgcaaggcgacgataacggccggcaagttttacaacgttaacattgtgacgttcgcgcaacttattaaaacctcctatacctactacatgatcatgaaggaaatgttctaa

SEQ ID NO: 97 - protein, 404 aa, Anopheles gambiae
MFRRLTHPTSPKQQHHRDRACDFTVMPHGLWLLEHSGLWGDPRRKRSFALMLLGTVLLLIVPKIVLGTGSDSFDSIARSTAEFIFCYNNYLMMAIFAIRRQPFEQLIGTVQLLFDKERKFQTTDSSRYVVYVNRQIMRYSRLYIIVQGVYFLIFNLLPAIVTYSAYFASSGDGEPVEFLLPVESRFFFLDIRHSIVHYTVFSLLACPAFLFTAYLTVVKGLVFIGIIVYNTLQYQLVSRGVRELKSLDPTTTQFRHRLTEIIDQHGAATRCTKLLDSVLNLMLLVQFTNTVLMCCLFLFYISKNFNSGAVNVLLLFLALTVENLCFSYFGNRLSTENTSVAIAVYSTDWYNYPPCLQKQFQQMIRHAYIPRGITVGKFHFVDMASFGQLLKAIFSYYLILKELF

SEQ ID NO: 98 - DNA, 1215 bp, Anopheles gambiae
atgttccgacgcttaacgcacccgacctccccgaagcagcaacaccatcgtgaccgcgcgtgtgacttcaccgtgatgccgcacggcctgtggttgctcgagcactctggcctgtggggtgatccccgacgtaagcgttccttcgccctaatgctgctcggcacggttctgctgctgatcgtaccgaagattgtgctcggcaccgggagcgatagcttcgactcgatcgcccgcagtacggccgagttcatcttctgctacaacaactacctcatgatggcgatcttcgccatccggcggcaaccgttcgagcagctgatcggcaccgtccagctgctgttcgataagcaacgaaagttccagacgaccgactccagccggtacgtggtgtacgtcaatcgacaaataatgcgctacagccggctgtacatcatcgtgcagggcgtgtacttcctcattttcaatctactgcccgccattgtgacgtacagtgcgtacttcgcatctagcggcgacggcgagccggtcgagtttctgctgcccgtcgagtcccggttcttctttctggacatacggcacagtatcgtgcactataccgtcttctccctgctcgcctgtccagcgtttctctttaccgcgtacctgacggtggtcaagggattagtctttatcggcatcatcgtttacaacacgctccagtatcagctcgtgtcgcgaggcgtccgggagcttaaatcgcttgacccaaccacgacccagtttcgtcaccggttaacggaaatcattgaccagcacggagcggccaccaggtgcacgaagctgttggacagtgtgctcaacctgatgctactggtacagttcaccaacaccgtgctgatgtgttgcctgttcctgttctacatatcaaagaatttcaactcgggcgcagtcaacgtgctgctgctgtttctagcccttacggtggagaatctatgtttctcctacttcggcaataggctgtcgacggagaatacttccgttgctatagcggtttacagtacggattggtacaactatccgccctgtttgcaaaaacagttccaacagatgatccgtcacgcctacataccgcgtggtattacggtgggaaagtttcatttcgtcgacatggcctcatttggacaactgctaaaagccatattctcatactatctcattttaaaagagctgttctag

SEQ ID NO: 99 - protein, 397 aa, Anopheles gambiae
MLSLRPEDPKAVMPFAKRLLRLSGFSPGTEQLGRCIYVNLSIYITVILVPKVCFPYPNTEAMIRGLGELIYFTNVYVGFFCFVVQHRHYRDLLDEIQSFVNIVYPTSQQPESLSERTLIKLNVKINILSVLYCRYIVVAAFIYWMVPCVVTYSSIHKAEVSMGNESIQSIQYYPNLEESFYWLDNRSSVSGYAAFSAVALIVFAFASYNHVTKLLTILSTIKYCSTLFHLVSIGIDELNLVSPAHIDRELKKLIQMHQLAIRCDVLLNQTLSYVMALQLALGTLTWCFTLLYILIIGLDVTAMMGLLIMMNMTSEMFGYCLFCTELTNTATTISQQIYVFQWEKHSPAVQKMVAMIIARGQAPLQIKACGFIPINLELFAKVVKTSYSVLIVLRDFV

SEQ ID NO: 100 - DNA, 1194 bp, Anopheles gambiae
atgttgagtctacgtccagaagatccaaaggcagttatgccgtttgcaaagcgtcttcttcggctatcgggtttcagtccgggtacagaacagcttggaagatgcatctacgtcaatctgtccatctacattactgtgatcttggttcccaaagtgtgctttccctatcccaacaccgaagccatgatacgtggattaggtgagctgatttatttcaccaacgtttacgttggcttcttctgcttcgtcgttcagcatcgccactacagagatctgctcgatgaaattcagtccttcgtaaatatcgtatacccaacatcccaacaaccggaatcactatcagaacgaaccttaatcaagctaaacgttaagataaatatactctccgtgctctattgtcgctacatagtagtggcagcctttatttactggatggtaccatgtgttgtaacgtacagctcgatacacaaagcagaagtgagcatgggaaatgaatcgatccagtcgatacaatactacccgaacctggaggaatcgttttactggcttgacaatcgtagctctgtgagcggctacgccgcgtttagtgcagtggcattgatagtctttgcttttgcttcgtataatcatgtgacaaagcttctaacgatcctgtccacgatcaagtactgtagcactctttttcacctcgtcagcatcggtatcgatgagttgaaccttgtaagtccagcacacatcgatcgagagctaaaaaaactgatacaaatgcatcagctggcaatacgctgtgacgtcttactcaaccaaacgttaagctatgtaatggctctacaactcgccctcggtacactgacatggtgcttcacgcttctatacatcctgatcatcggtctggacgtaacggcaatgatgggtttgctaatcatgatgaacatgacatcggaaatgtttggttactgcttattttgcaccgaacttacaaatactgcaacgaccattagccaacagatctacgtgtttcaatgggaaaaacacagtccggcggtacagaaaatggtggcgatgattatcgcccgtggccaagcaccgctgcagattaaagcgtgtggctttatcccgatcaatctcgaattgtttgctaaggtggtcaagacatcttactcggtgcttattgtgctaagggattttgtgtaa

SEQ ID NO: 101 - protein, 397 aa, Anopheles gambiae
MLFQALPNDRAVLPLLLYIQERLGLWGESYRARFLFVVVAFSITVCIPKFTTTYTNLETFICSMAELVFIGNVFGGAMLLWTEYDAFRQFIEQVNSLTKHFYREDPLKEHVLQFNYLIHRYTNRYCFSVMILIMFYLAAPVITSFVVYFQSLWKSYHLANGTVRTWDISHRQFSLHMEQSFYGLQHRTNILHYTLYIAVIVPMMFVTACTVHMKVLTIASSVRYAEMLLHIVMLKVDSLPKQKSIREELHDIIKVHQRTLDCIALLVKALRPVLLLQLVFCVLIWCLMMLYFTITDGLSVKFFNIGIMFLVITIETFSPCYFGTRLSTQAVELSESVYACGWPAMDRDIQQRLRMVLHRTQSPVGIQAGKFCFVDMELFQKMVNKSYSCFIVLKDAL

SEQ ID NO: 102 - DNA, 1194 bp, Anopheles gambiae
atgctgttccaagcgttgccgaacgatcgtgccgtactgccgttgctcctgtacattcaggagcggcttgggctttggggtgaatcctaccgggcacgctttctgtttgttgttgtggcgtttagcattactgtatgtattccgaagtttactactacctacaccaatctggaaacgttcatctgctcgatggcggagcttgtcttcatcgggaatgttttcggcggtgcgatgctgctctggacagagtacgatgccttcagacagtttatcgagcaagtgaacagtttgacaaagcacttttatagagaggatccgctgaaggagcatgtgttgcagtttaattatctaatccatcgctacaccaacagatactgtttctcggtgatgattttaatcatgttctaccttgcggcaccagtaataaccagcttcgtggtatactttcaatccttatggaaatcttaccacctagcaaatggcactgtccgtacctgggatatttcacatcgacaattttccctccacatggagcaaagtttctacggactccagcatcggaccaacattcttcactacacactctacatcgcagtcatagtgccgatgatgttcgtaacagcctgtaccgtgcatatgaaggtgctgactattgcatcttctgttcggtacgctgaaatgctgctccacattgtgatgcttaaggtagacagcctacccaaacagaagtccatccgcgaagaactgcatgacattataaaagtacatcagcggacactcgactgcatcgccctgctcgtgaaggccctacggcccgtcctattattacagctcgtgttttgcgtcttaatctggtgtttgatgatgctctactttaccattactgatggcttaagtgtaaaatttttcaacatcggaataatgttcctcgtcatcacgatcgaaacgttcagtccgtgttattttggaacgcgtctctctacccaggcagtggagctttctgagagtgtgtatgcctgcggatggccagcgatggaccgcgacatccagcagagactgcgcatggtgctgcatcgcacgcaatcgccggtcggcatacaggcaggtaaattttgcttcgtcgatatggaactgtttcagaagatggttaataagtcctactcctgctttatcgtgctgaaggatgccctctag

SEQ ID NO: 103 - protein, 387 aa, Anopheles gambiae
SLTPTDAGVQLQTERLWLRALFLLYQLLLPTQAIIWLWRTWAVAYIEHNKPLAISLLCGQFALTSIVARYMLLLRSYAQLQPIQRHLNEQRFLRGHPRAHALRQQAFRTNNVLMLALMVYGVLNFVVYEASGLHWQEIFRMPDYLLATNRPLTWTLHLIMRPMTFNGLGAFIATFVSIHTMLTVLHAELLLVEFAFDGLLERVERHVQAAGAQESPLLWQQFNRELGRCVREHCVVLKQVREVNRVHSFSITVQYYTALLSLAIDAFFISYYGLNFVSVCVSIFSVLLVFEWYYCCKLVEDLQATNKRIGWTLYNDKWSDWLQYGREQPAALREFRTTLSIILLATQRSLSLRGSDIVEVSWQTFASMLKTSYSVMMFLIELRRLNR

SEQ ID NO: 104 - DNA, 1164 bp, Anopheles gambiae
tcactcaccccaaccgacgcaggtgtgcagctgcaaactgaacggctctggctgcgcgccctctttctgctctaccagctgctgctgccgacgcaggccatcatctggctgtggcgtacctgggcggtggcgtacatcgagcacaacaagccgctcgccatcagcctgctgtgcggccagttcgccctcaccagcatagtggcgcggtacatgctgctacttcgcagctacgcccagctgcagccgatccagcgccacctcaacgagcagcggtttctgcggggccacccgcgagcgcacgcactgcggcagcaggccttccgcaccaacaacgtgctgatgctggcgctgatggtgtacggcgtgctcaacttcgtcgtgtacgaggcgagcggtctgcactggcaggagatattccgcatgccggactacctgctggcgacgaaccggccgctcacctggacgctgcacctcatcatgcgcccgatgacgttcaacgggctcggcgcgttcattgcgaccttcgtcagcatacacacgatgctgaccgtgctgcacgccgagctgctgctggtggaatttgcgtttgacgggctgctggagcgagtggagcgccacgttcaggctgccggtgcgcaggagtcgccactcctctggcagcagttcaaccgcgagctgggcagatgcgtccgcgagcattgtgtggtcctgaaacaggtgcgggaggtgaaccgggtgcacagcttctccatcactgtgcagtactacaccgcgctgctctcgctcgccatcgacgccttcttcatctcgtactacgggctcaactttgtgtcggtctgcgtgtcaatcttctcagtgctgctcgtcttcgagtggtactactgctgcaagctcgttgaagacctgcaggcaacgaacaagcggatcggctggacgctgtataacgataaatggtccgactggctgcagtacgggagggagcagccggctgccttgcgcgagttccggaccaccctcagcatcatactgctcgcgacgcagcgcagcctgtccttgcgcggcagcgacatcgtcgaggtgtcgtggcaaacgttcgccagcatgctgaagacgagctactcggtgatgatgtttctgatcgagctgaggcggctgaatcgttga

SEQ ID NO: 105 - protein, 376 aa, Anopheles gambiae
MKLLELDNPREAIAIGCRLLKLFGLGRDERFKLVYWLQCVAYLAFSIVPRLLVEIEDMVALMRLIAELVFVVYLCLQIMALYCRRRQLYRLVDMLQQCIDIPYSEQIESFLIRSNVKINQSSAAYARFFMCVYVLYCTMSPLASGFVYIRNQRNATGVQEDLYDLDIRYNPLHYSIYAGLIFVLSAISSLSLCTKDVIDIAAIKTVTLVFGIVTMQIRDLHEQITQERLNRVIKSHSNALSCATQLEQALNLSVLFQFASCSAIWCLMLFYILLMGLDSRVLSVVLLLVIVSIETYAYCMLGSQLTTQGEDLLMALQQLSWYDQPVPIQRQILLMIRRSQTPLILRAGKLFSANVVQFGDIVQKSYSFFLVLKNVF

SEQ ID NO: 106 - DNA, 1131 bp, Anopheles gambiae
atgaagttactagagctagacaaccctcgtgaagcaattgccatcggctgccgtctgctcaaactgttcggattggggcgggatgaacgattcaagctcgtttactggctccagtgtgtggcatatctggcgtttagtatcgtaccccgacttttggtagagatcgaggatatggtagcgctgatgcgccttattgcagagctggtgtttgtcgtttatctgtgtttgcaaataatggcactgtactgccgacggcgccagctttaccgactggtggatatgttgcagcaatgcatcgatataccctactcggagcaaatcgaatcgttcctcatccgatcgaacgtcaaaatcaaccaatcgtccgcagcctacgcgcggttcttcatgtgcgtgtacgtgctgtactgtacgatgtcaccgttagcgtcgggcttcgtctacattcgcaaccagcgcaatgcgacgggcgtgcaggaagacttatacgacctggacatccgttacaatccgctgcactactcgatctacgccggtttgatatttgtgctgtcggcaatatcttcgctatcactctgcaccaaggacgttatcgacattgcagccattaaaacggtgacactggtgtttggcattgtaacgatgcagattcgtgacctgcacgagcagatcacccaggagcggttgaaccgtgtcatcaaatcgcatagcaacgcgctgtcttgcgcgacgcagctcgagcaggcactaaacctatccgttctgtttcagtttgcctcgtgcagcgccatctggtgtctgatgctgttctacattttgctaatgggattggattcgcgtgttctgagtgtggtgttactactggtaattgtatcgatcgaaacctacgcctactgtatgctcggctcgcagttaactacacagggtgaagatctgctaatggctttgcagcagctctcctggtacgaccaaccagtccccatccagcgacaaatactactaatgatacgacgctcgcaaacaccactcattctgagggcaggcaagctgttcagcgcaaacgtcgtgcagtttggtgacatcgtgcaaaagtcttactcctttttcttggtgctaaaaaatgtattctaa

SEQ ID NO: 107 - protein, 366 aa, Anopheles gambiae
MYYLEQLRALVRRYLERRSPDPRIQHTFIVQSINRVGGMLGIDIFTPGYSSTNLLLRMVLLNTFTFFWINLYSLTTTYGNLVDFMYSFETLLYVGIACIKMYVFIKNKTLILQMHQYMIDFFDHFHGDREQDELLVRTLNNTTLLSSLFAVCSSSAPGLLFVGSLLWSIAVEYVLPFGFFIPTVGMDTLQGYTLNYGFQMLETTLMVIGIISSESAFFMFQQNACLQVDMLRYSKSMCSLFELHFFIVFGCIFFQLVSNVVVIVSVPDWYPGYFLFIMLTVQLFFSCALGETFNIKSDELTVAIYNVPWYNMEVRDQKAMRLLLMASQNPGRLSYGFGTVNMRAFFEIFRKTYSIAMMMISVNEEE

SEQ ID NO: 108 - DNA, 1101 bp, Anopheles gambiae
atgtactatctcgaacagctccgtgcgctagtgagacgttatctcgagcgtcgctcgccagatccacgcatccaacatacgttcatcgtgcagagcattaaccgcgtcggtggtatgctcggtatcgacatctttacacccggctactcctccaccaatcttctgctgcggatggtcctgctgaacacgttcacctttttctggatcaatctctacagcctgaccaccacctacggcaatctggtcgactttatgtacagcttcgagacgctgctgtacgtgggcatcgcctgcatcaagatgtacgtgttcatcaagaacaaaacgctcatcctgcagatgcaccagtacatgatcgactttttcgaccacttccacggcgatcgggaacaggacgagctgctggtgcgaacactaaacaacacgaccctgctgtcgtcactgtttgcggtatgttccagctcggcgccgggcttactctttgtcggctcgctgctctggtccattgcggtggagtatgtgctgccgttcgggttctttatccctacggttggcatggatacgctgcaggggtacacgctcaactatgggtttcaaatgctcgaaactacgctgatggtgatcggcatcatctcgagcgagagtgcattctttatgtttcagcagaacgcgtgcctgcaggtggacatgctgcgctactcgaaaagcatgtgcagcctgttcgaactgcacttcttcatcgtgttcgggtgcatcttctttcaactggtcagcaatgtcgtggtgattgtatcggttcccgattggtatcccgggtattttctgttcatcatgctaacagtccagctgttctttagctgtgcattgggagaaacgttcaacatcaagagcgatgagcttacggtggcgatctacaacgtgccttggtacaatatggaagtacgcgaccagaaagcgatgcgcctgctgctgatggcttcccaaaatccggggcgactttcgtatggctttgggactgttaatatgcgtgccttttttgagattttcagaaagacctactccatagccatgatgatgatcagcgttaatgaggaagagtaa

SEQ ID NO: 109 - protein, 388 aa, Anopheles gambiae
MIRFFTIHKPPGVPHLALKLLHAVGIANGETFSHRFTAVYLLFIFIIAIPKLFCGYTSFEASVVGLAELFFQLNNFTGLLLVLVSSKQLQCLVRVGQTIADEVFQCAQTDMRQLLTSHHKRMHTWTRYYCLVILYTVSIFATAPICATFWSYVRAAHRNTTAQYVLHMEEDFYGLQIRSSLRSCLMFAIPMVPTSYVCAYVGCAKIMIVFNFTSYCTVYFRLVALQLQYQTRTVPSDRDSIRTIVAMHQQALCCADLLETIVSPIMLMQIVLCVLMSSSMVLYFTFPTMSGHMINVLLLFLVVSTETFGYCYLGTQLSMESARIAYAVYNGKWEQQPREIAKHLQLILLRAQKPIGITAGKFCFINMEQFAKLLKTTYSVFILLRDLL

SEQ ID NO: 110 - DNA, 1167 bp, Anopheles gambiae
atgatacgatttttcaccattcacaagccaccgggagtgccacatctcgcgttaaaactgcttcatgccgtaggaattgccaatggagaaacattttcgcatcgcttcaccgcagtgtatttgttgttcatttttatcatcgcgattcccaaactattctgcggctacacctccttcgaggcgtccgtcgtcgggttggccgagctattctttcagctcaacaactttactggcttgttactggttttggtaagtagcaaacagttacagtgcttggttcgagttggccaaactatcgctgacgaagttttccagtgcgctcagactgatatgcgccagctgctaacgtcccatcacaagcgaatgcacacatggaccagatattactgtctagtcatcttgtacaccgttagcatttttgctaccgcaccaatttgcgccacgttctggtcgtacgttcgggctgctcatcggaacaccaccgcacagtacgtgctccatatggaggaagatttttacggactgcagattcgttcctcactgcgaagctgtcttatgttcgccatcccgatggtaccgacgtcgtacgtctgtgcatatgttggatgtgccaaaattatgatcgtcttcaatttcaccagctattgcaccgtctactttcggctggttgcactccaactgcaataccaaactcgaacagttccgtctgatcgtgatagcattagaacgatcgttgcgatgcaccagcaggcactgtgctgtgctgatttgttggaaaccatcgtatccccgatcatgctgatgcagattgtcctgtgcgttcttatgtcgagctctatggtactgtactttacattcccgactatgagcggccacatgataaatgtgttgttgctgtttttggttgtttcaaccgaaaccttcggctactgttacctcggtactcaactttcgatggagagcgcacggatcgcatatgccgtatacaacggaaaatgggagcaacagccgagggagatcgcaaaacaccttcagctaattttactacgcgcacaaaagcccattggtataaccgccggcaagttttgcttcatcaacatggagcaattcgcaaagctccttaaaactacctactcagtgtttatcctgctgagagatttattgtaa

SEQ ID NO: 111 - protein, 400 aa, Anopheles gambiae
MDIVSKQGEFPLVKLSTKLLRIIRFWNDSPGQRIPSLGLLVTAIYPLIWLIPSWLFLVSSQDNITRFMKAANEQIVFSLICCKLCFYAIHFRRWEKLYYDLQRSFSTVLNNPNLEIQTILGHVTKSTHKLTKYYCSTVSFNCAAYGLFPMLFIVVKYAVTGSYDVPLSTPIEAKYFIPGLRTNFWVWLPVDLTLNAILELHGFALVFVETFTWNLVYATSCMFRILQIQVNELSHQSRNEKEWNGKLKTFIALHDSVLRSAETLEEILSLQMLLLYISTILALCLGMVVLSLAVNEVYVLLTTMAVFGYCIFQTFSFSYLGTELIEQSEAVADAIFHSKWYTQKLNRQKDMCFLMMRANKPVKLTAAKLFVVTRDSFTQVIKQAYTIFTLMSQFLDNPVN

SEQ ID NO: 112 - DNA, 1203 bp, Anopheles gambiae
atggacattgtgagtaagcaaggtgaatttccgctggtaaaactctctacaaagttgttaagaatcattcgtttttggaacgattccccgggacaaaggattccttccttaggtttgctggtaactgccatatatccactaatatggcttatccctagctggttgtttcttgtgagctcgcaggacaatatcacacgtttcatgaaggcagctaacgagcagatagtgttctctcttatctgctgcaagttgtgcttctacgcaattcattttcgtcgttgggagaagctgtattacgatctgcaacgttcgtttagcaccgttctgaacaatccaaatctagagattcaaaccatattgggacacgtaacgaaatcgacccataagctcactaaatactactgttctacagtaagcttcaactgtgctgcgtacggcttatttccaatgttgttcatagtggttaaatatgccgtgacgggctcgtacgacgtgccgctttcaacaccgatcgaagcaaagtattttatccccggcctgcgtacaaacttttgggtttggttgccagtggatttaacactaaatgccatactggagttgcatgggtttgctttggttttcgttgaaaccttcacatggaatcttgtgtatgccacatcctgtatgtttcgaatcctgcaaatccaggtcaacgagctttcgcatcaaagtcgaaatgaaaaggaatggaatggcaagcttaaaacattcatagctctgcatgattctgtgctaagatcggctgaaacactggaggaaatattgagtttgcagatgttattactttacatatcgaccattttggctctgtgtctgggtatggtcgtgctgtctttggctgtcaatgaggtgtatgtgctgttgactaccatggccgtatttggctactgtatttttcaaaccttttccttctcttacctcggcactgagctcattgagcaaagcgaagcagtagcggatgcaattttccacagcaaatggtacacgcagaagctgaacagacagaaagacatgtgtttcttgatgatgcgagcaaataagccggtgaaattgactgccgccaagttgttcgttgtaacacgcgattccttcacccaggtaattaaacaggcatacacaatctttacattgatgtcacagtttttggacaaccctgtgaattaa

SEQ ID NO: 113 - protein, 400 aa, Anopheles gambiae
MDIVSKQGEFPLVKLSTKLLRIIRFWNDSPGQRIPSFGLLVTAIYPLIWLIPSWLFLVSSQDNITRFMKAANELIVFSLIFCKLCFYAIHFRRWEKLFYDLQRSFSSVLNNPSLEIQTILGHVTKSTHNLTKYYCSTVSFNCAAYGLFPMLFIVVKYAVTGSYDVPLSTPIEANYFIPGLRTNFWVWLPVNITLSAMLELHGFALFFVETFTWNLVYATSCLFRILQIQANELSHQCRNEKEWNGKLKTFIALHDSVLRSAETLEEILSLQMLLLYLSTILALCLGMVVLSLAVNEVYVLLTTMAVFGYCIFQTFSFSYLGTELIEQSEAVADAIFHSKWYTQKLNRQKDMCFLMMRAKRPVKLTAAKLFVVTRDSFTQVIKQAYTIFALMSQVLDDTMG

SEQ ID NO: 114 - DNA, 1203 bp, Anopheles gambiae
atggacattgtgagtaagcaaggtgaatttccgctggtaaaactctctacaaagttgttaagaatcattcgtttttggaacgattccccgggacaaaggattccttccttcggtttgctggttactgccatatatccactaatatggcttatccctagctggttgtttcttgtgagctcccaggacaacatcacacgtttcatgaaggcagctaacgagctgatagtgttctcccttatcttctgcaagttgtgcttctacgcaattcattttcgtcgttgggagaagctgttttacgatctgcaacgttcgttcagcagcgttctgaacaatccaagtctggagattcaaactatattgggacacgtaacgaaatcgactcataaccttactaaatactactgttctacagtaagcttcaactgtgctgcgtacggtttatttccaatgttgttcatagtggttaaatatgccgtgacgggctcgtacgacgtgccgctttcaacaccgattgaagcaaactattttatccccggtctgcgtacaaacttttgggtttggttgccggtgaatataacactaagcgcgatgctggagttgcatggctttgctttgtttttcgttgaaaccttcacatggaatcttgtgtatgccacatcctgtttgtttcgaattctgcaaatccaggccaacgagctttcgcatcaatgtcgaaatgaaaaggaatggaatggcaagcttaaaacattcatagctctgcatgattctgtgctaagatcggctgaaacactggaagaaatattgagtttgcagatgttattactctacttatcgaccattttggctctgtgtctgggtatggtcgtgctgtctttggctgtcaatgaggtgtatgtgctgttgactaccatggccgtatttggctactgtatttttcaaaccttttccttctcttacctcggcactgagctcattgagcaaagcgaagcagtagcggatgcaattttccacagcaaatggtacacgcagaagctgaacagacagaaagacatgtgtttcttgatgatgcgagcaaagaggccggtgaaattgactgccgccaagttgttcgttgtaacacgtgactccttcacccaggtgatcaaacaggcgtacacaatctttgcacttatgtcacaggttttggacgacacaatgggttaa

SEQ ID NO: 115 - protein, 403 aa, Anopheles gambiae
MSALVHLAKDHIQRIADGGQFVIVNGMDRFIGFFAWDVKLNATWLKMTLIVFAVGYEITAIAAMALASVKGVFTERSFTMSFVTMTGAMCIVIWLSLAAFRRDLTGTVKFLQHRQCTIHRQSAARKALMDRVNRYLWLFYLQNIAQVFFWINLLRNCSPLAVFELSLLDSVNVLLYPLAMTLMSLMFIHTIMIVSTLLSALSLEFYWLGQEFEQVFAQCNTFAATARKRYWDGLKRRIDTCVIEHQRLLGQISTLRNNLKLYLLLNLVADFSLITFAGCQMVISSEGDQHLYSILAALTACLNMLNFGGLCDLLKIQVHAIKFRLYSSQWTDYLRPVSGPLYPRCRRIRSSILIVMTRAEHELRISCGSVYDMSLTTCWAVLQFSYSVFTLLLSFFENEPRDQ

SEQ ID NO: 116 - DNA, 1212 bp, Anopheles gambiae
atgtccgctttggtgcatctagcaaaggatcacattcaacgcatcgccgatggtggccagtttgtgatcgtcaacggtatggatcggtttatcggattttttgcgtgggatgtgaaactaaacgcaacctggctgaagatgacgctgattgtgtttgccgttgggtacgaaatcaccgccatagctgccatggcgctggcctcagtaaaaggcgtctttacggagagaagcttcactatgagcttcgtcacaatgactggggccatgtgtatcgtgatttggttgtcgctggccgccttccgtcgcgatctgaccggaacagtcaagtttctacagcatcgtcagtgtactattcacagacagagcgcagctcgcaaagctctgatggaccgtgtcaaccggtatctgtggctgttctatctacagaacatagcgcaagtatttttttggatcaacctcctaaggaactgcagcccgttggcggtgttcgagctgtcgctgctggacagtgtaaatgtgctgctgtacccactggcgatgacgcttatgtcattgatgttcattcacacaataatgatcgtgtctacgttgctaagtgccctatcgcttgagttctactggttgggacaagagtttgagcaggtgtttgcccagtgcaatacgtttgccgctaccgcacggaagcgttactgggatgggctaaaacgaaggatcgacacttgcgttatcgagcatcagcgactgctgggacagatcagcacactgcgcaacaatttgaagctttatctgctgctgaatctcgttgccgatttctcgctcattacgtttgccggctgccagatggtcatctccagcgaaggagatcagcatctgtacagtattcttgctgcgttgaccgcatgcctgaatatgctcaatttcggtgggttgtgtgatttgctcaagattcaggtgcatgcaatcaagtttcgcttgtacagctcccagtggacggactacttgcgccccgtatcggggcccctctatccgcgctgccgacgcatccggtccagcatactcatcgtgatgacccgggccgagcacgagctgcgcatcagttgtggtagcgtctacgacatgtccctcactacttgctgggccgtgctacagttcagttattcagtgtttacccttctgctaagcttcttcgaaaacgaaccgagagaccagtga

SEQ ID NO: 117 - protein, 415 aa, Anopheles gambiae
MFSASAEMEWFRQQRHAICHLREGSDYLRYLRPFQLIAGYPINPRPALSKLATVVRLLAYLTYLGTLLHKISYVLYRPEDINYVSFVSGGITVLVAVLLLMLIFTVHYDAFQQLGTFLNDRAFARDHPLATGIRDRWYRWSNGLILGPQCCIVLILLQTWISRQHLKKHTMLVVRGEPVGTEFDHFLYMSCLYFPTVGFFMGCSIVNAMLVGFLGEMELLATCLGELFETVERQVKEEGPTGRPDSRALYWSTLHGELRRCAQRHCAIFTMLPKLQRMASFVFLQHHIFSLGLVVAGSYVTLRGPALRENIVLSEYPISVVLEYFIFCQLVEKLQDMNRSIGDRLYGTEWMLKLQYSRDFQREYRSAALTIRLLIMRSQHRVRFTCGSINPVSMEKFTEFLNLSYSIVMFLLSIN

SEQ ID NO: 118 - DNA, 1248 bp, Anopheles gambiae
atgttcagtgcatccgcagaaatggagtggttcagacagcagcgccacgccatttgtcatctacgggagggaagcgactatctacgctacctgcgcccgttccagctgatagccggctatccgatcaatccccgaccggcactctcgaaactggcgaccgtcgttcggctgctagcctacctgacataccttggcaccttgctgcacaagattagctacgtgctgtaccgccccgaggacattaactacgtgtcgttcgtgtccggtggcatcaccgtgctcgtggccgtactgctgctgatgctaatctttaccgtccactacgacgcgttccagcagttgggcacctttctgaacgaccgtgcgtttgcccgcgaccatccgctggcgaccggtatccgcgaccgttggtatcgctggagcaacggtctcatactgggaccgcagtgctgcatcgttctgattctcctgcaaacgtggatctcgcggcagcacctgaaaaagcacaccatgctggtggtgcgcggtgagccggtcggtaccgagtttgaccacttcctgtacatgagctgtctctacttccccacggtgggcttcttcatgggctgctcgatcgtgaacgcgatgctggtgggctttctcggcgagatggaactgttggccacctgtctgggggaactgttcgagacggttgagcggcaggtgaaggaggaaggacccactggccggccggatagtcgcgcgctctattggtccaccttgcacggcgagttacgccgatgcgcccagcggcattgtgcaattttcacgatgctaccgaagttgcagcggatggccagcttcgtgtttctgcagcatcacatcttctcgctcgggctggtggtggccggctcctacgtgacgctgcgcggtccggcactgcgcgaaaacattgtgctcagtgagtatcccatctcggtcgtgctcgagtactttattttctgccagctggtcgagaagctgcaggatatgaaccgatcgattggcgatcggctgtacgggacggagtggatgctgaagctgcagtactcgagagactttcaacgagagtatcgatcggcggcgcttacgattcgattgctaattatgcgcagccagcaccgggtccggttcacctgcggctcgatcaatccggtctcgatggaaaagtttaccgaatttctcaacctatcctactcgatcgttatgtttctgcttagcatcaattag

SEQ ID NO: 119 - protein, 425 aa, Anopheles gambiae
MIDLVTRIRRKLLALERKLANDLDQFVLLHHLTFLFAIRNDAPRGVGQFMRWCFHLMAPVFVLSSYCYKAYWYMSHSEYSFALFNVVGTIWIMAGAFVRRLLFDRGLLTRLEQFLNDRSFREDEPLVRAARQHVKVQNNRYLFAVCLTLVLEASIFSGTNLMLQPEFMLLYQGHAVGGFLIQLLYGWATCLWGSLYVLIFAFIYVLLNVFRGEMSLLVESFERIDECFHKYRPELNTASAGEREEEFWRELQALIKLNVQRHVELLENLVDFGSILKPFSFIQYYGSFTLIGYYCFILMYKGVTPLTVVYIAFIVFLVAESFLFCRILSQINDLHARIGTVMCELEWYDKLRFSTRFASAYRQMRASFLIIIIRSQKPLSFSISAAGTISMARFADLLNSSYSLMTVMFQLKERIIAKLTSDGNN

SEQ ID NO: 120 - DNA, 1278 bp, Anopheles gambiae
atgatcgatcttgtgactcgcattcgccgaaagttgctcgccctggagcgtaagttagccaacgatctggatcaatttgtgcttctgcatcatctcacttttctgttcgccattcgcaatgatgcaccaagaggagtgggccaatttatgcgctggtgctttcatctgatggcgcccgtctttgtgctcagctcctactgctacaaagcctactggtacatgtcgcacagcgagtacagcttcgcactgttcaatgtcgtgggcactatctggatcatggctggtgcatttgtgcgtagactattgttcgatcgtggcctgctgacacgcctggagcagttccttaacgatcgcagctttcgtgaagatgaaccgctggtgcgtgcggctcggcagcatgtaaaggtgcagaacaatcgctacctgttcgcggtctgccttaccctagtgttggaggcatctattttttccggcacgaatctgatgcttcagccggagtttatgctcctttaccagggccacgctgtgggtggattcctcatccaactactgtacggttgggcgacctgcctctggggatcgttgtacgtgctgatctttgccttcatctacgtgctgctgaacgtgtttcgcggggagatgtcattgctggtggagtcgtttgagcgtattgacgaatgttttcataagtatcgcccagagctgaacactgcgtccgccggggagcgggaggaagagttttggcgcgagctgcaggcacttatcaagctgaacgttcagcgccacgtggagctgctggagaatttggttgattttggttcgattctcaaacccttctcattcatccagtactacggttcgtttacgctgatcgggtactactgcttcatcctaatgtacaaaggcgtcacaccgcttaccgtggtgtacattgcgttcatcgtttttcttgtggcggaatcgtttctgttctgtcgtatcttgtctcaaattaacgatcttcacgcgcgtattggtacagtcatgtgcgagctggaatggtacgacaagctgcgtttttcgacccggttcgcttcagcctaccggcagatgcgggcaagctttctgatcatcatcatccgatcgcagaagccgctatcgttcagcatcagtgccgctgggacgatctcgatggcgcgcttcgccgacctgctaaacagtagctactcgttgatgaccgtaatgtttcagctgaaagaaagaattattgccaagctgacttcggacggaaacaattaa

SEQ ID NO: 121 - protein, 419 aa, Anopheles gambiae
MWHHQVQLWFRFLLGRFTTFTDSSDYFGLYKTLATISAIHYDASCWFDRAIWIVYRSLPILVNISYFYKAYRLILFPEDNTSAASVIASVWGFTEGTLRICLIELRYGTLASIMSFLNERSYRQQDSLVRQQRATLFGENNRIQLILVATMLMEAIWFMTTQLFSRDAFMLQVNGHVVDSIAVQILYGLLSNVWGLIYVLSFAIFYIIMNTLHLEMSILLDGITSVQFTVMRRLKQRMETLAASGHSSTQVFWSILQPELNSHISRHVDLLDNLKEFSSIVGPFSFVQYYGTLALIADCGFILSIEGLSANGMIYLLFVTVLVFQSFILCRGIEKLNDLNEAIGQALYSGFDWPDMLQYDQRFRRQYVTVRHTLMLVIGRSQKGFQCSYGGLGSISMERFAQLMQKSYSLLTILLQFAK

SEQ ID NO: 122 - DNA, 1260 bp, Anopheles gambiae
atgtggcatcaccaggtgcagttgtggtttcggtttctacttggacgattcaccacattcaccgacagttcagactacttcggtctgtacaaaacgctggcaacgatatcggccattcactacgatgcgtcttgctggttcgatcgagcgatctggatcgtctaccgatcgctgccaatcttggtgaacatctcctacttctacaaagcctatcggctcatcctgttccccgaagacaacacctcagccgccagcgttatcgcatcagtgtggggctttaccgaaggaacgctacgcatttgtctcatagagctgcggtatggcacgctggctagcattatgtcgttcctgaacgagcgatcgtaccggcagcaagattcgctggtgcgtcagcaacgtgccaccctgttcggcgagaacaaccgcatccagctcattctcgtcgccacaatgctgatggaagcgatctggttcatgacgacgcagctcttcagccgggatgcctttatgctgcaagtgaacggacacgtggtggacagcatagcggttcaaatactttacggcctgctgtcgaacgtgtggggcctaatctatgtgctttcctttgccatattctacatcatcatgaacacactgcatctggaaatgagcattctgctggacggcattacaagtgtacagttcacggttatgcgtcggttgaagcaacgaatggaaacgctagcggcgtccggacattcctcaactcaagttttctggagtattctacagccggagctgaacagccacatctcacggcacgttgatctccttgacaacctcaaagagttcagctctattgtgggcccattttccttcgtacagtactatggtaccttggcgctgattgccgactgtggattcattctttccatagagggtctgtcggcgaacggtatgatctacctgctgttcgttaccgtgttagtgtttcaatcgttcatcctgtgtcgcggaatcgagaagttaaatgatctgaacgaagccattggacaagccctgtatagcgggtttgactggcccgacatgcttcaatacgatcaacgctttcgccgccagtacgtaaccgtgcggcatacgttaatgctcgttattggccgctcccagaaaggattccagtgttcgtacggaggcctcggcagcatctccatggaacgattcgcccagctcatgcagaaaagctactcgttgttaacgattttacttcagttcgccaagtaa

SEQ ID NO: 123 - protein, 416 aa, Anopheles gambiae
MVRSQPFRLSLVRKYWDKYFTFTDTVDYFNLLNTFGTLFALHYHTRQPRWTVKKLLWTVYRTLYLLSYLSYCYKVYWLFSHWQYSTAAANLLGALGLCSGALLRLLLIEQNYPTVHRLQQFLNDRTYLREDPWARTERSKLYRHNNRFLVVLISAISVESLCFLARLLLTRPEFMLQYGGAVLGGPSVQLAYGMVTACWGIIYVLSFIVFYTLLTGFRLEMQLLARSFQQLEETLVPTGVGMDDQNEWEYWDNLQQRLTHRIKRHLELLENLRIFRSIVAPFAFLQYYSTFGLIADSFFVVSFEGFTGYSMAYVLFASFLILESLLLCRGVEDLNDLNRQIGTILYNFDWPRLLRFSIHYRRQYFSVRRTILLVILQSQQSLRFSYGAHGEISMHSFAELMQKSYSMLTFMLQFQN

SEQ ID NO: 124 - DNA, 1251 bp, Anopheles gambiae
atggtgcgcagtcaaccgttccgtctgtccctggtacgcaagtactgggacaaatacttcaccttcaccgacaccgtggactatttcaacctgctcaacaccttcggtacactgttcgcgcttcactatcacacccgccagccacgctggacagtgaagaagcttctctggacagtttatcgcaccctctacctgctgtcgtatctgtcctactgttacaaagtgtactggttgttcagccactggcagtacagtacggctgcggccaatctgctcggtgcgctgggcctgtgcagcggggccttgctgcggctgctgctgatcgagcaaaactatcccaccgtacaccggctgcagcagtttctgaacgatcgaacctacctgcgcgaggatccgtgggcacgaaccgagcgttccaagctttaccgccacaacaatcgctttctggtggtgctcatcagcgccatcagcgtggagtcgctgtgctttctggcccggctgctgctgacgcggcccgagtttatgctgcagtacggtggagccgttctgggtggcccgtcagtgcagctcgcctacggcatggtaactgcctgctggggcatcatttacgtgctctcgtttatcgtgttctacacgctgctgaccgggtttcggcttgagatgcagctgctggcgcgttcctttcagcaactcgaggaaacgctcgtacccaccggcgtagggatggacgaccagaacgaatgggagtactgggacaacctgcaacagagactgacccatcggatcaagcgccatttggagttgctcgaaaatcttcgcatctttcgctcgatcgtcgcccctttcgcctttctgcagtactacagcaccttcggcctgatagcggactcgttcttcgtggtgtcctttgaaggttttaccggctacagcatggcgtacgtactgtttgcttcgtttctgatcctggaatccttgctgctgtgccgtggggtggaagatttgaacgatttgaatcgacaaatcggaaccattctgtacaacttcgattggccccggttgctgcgcttttccatccactaccgacgtcagtacttcagcgtacggcgaacgattctgctcgtgattttgcagtcccaacaatcgctccggttcagctacggtgcacatggggaaatttcaatgcacagctttgcggagctgatgcagaaaagctactcaatgctgacgttcatgctgcagttccaaaactaa

SEQ ID NO: 125 - protein, 412 aa, Anopheles gambiae
MYLTQLFASMRTQFLHRITHYTKHSDFFIMQRYFEKIYAIHYTPHGWHDRILWYLYRALYGLIYLSYIHKTHWVLHHPQDSFSTANILGVMWFFSVVILRVAILEWYYPLMLRMQTFLNNHTSYQRTDPWAVGRRARFYRRTNRVILTVMGINLAETVCFTATNVMKLDEFMLQFRGAIVGGWPVQIVYGVLTMGFGGMYCMGFMMCYLLLSIFKLEVDILIRSLEEVERSDRLESDFGDSADIFWNNIVDQLRPHMQRLDELFIQLQHLKAVIGPIAFVQYYSTYLIIADCCLILVSHGLSSFSIVYFISMLVFLTESFLLCHGVENLRDLKPRIASTVYDFDWMLQMRCPNPRHRAQYRHVRRTLLLLTAQSDQTIQFSFAGIGEISMNSFAQLLEKSYSMLTFLLQFAK

SEQ ID NO: 126 - DNA, 1239 bp, Anopheles gambiae
atgtaccttacgcagctattcgccagcatgcggacccagttcctgcaccgtatcactcactacaccaagcattcggatttcttcatcatgcagcgctactttgagaagatctacgccatccactacacaccgcatggctggcacgatcgtatcctctggtatctgtaccgtgcgctgtacggtctgatctatctgagctacatccacaaaacccactgggtactgcaccacccgcaggacagtttcagtacagcaaacatccttggcgtgatgtggttcttcagtgtcgtcattctgcgcgttgccattctcgagtggtactacccgttgatgctacgcatgcagacctttctgaataatcacacctcctaccagcggaccgatccatgggcggttggcagacgggcccgcttctaccgtcgaacgaatcgtgtgatactgaccgtaatgggtatcaacttggcggagacagtctgcttcactgccaccaacgtgatgaagctggatgaatttatgctgcagttccggggagcgatcgttggtggctggccggtgcagattgtgtacggcgtgctgaccatggggtttggcgggatgtactgcatgggtttcatgatgtgctatctgctactaagcatctttaagctggaggtggacatactgatacgttcactggaggaggttgaaagaagtgatcgtttggagagtgattttggagatagtgcagatatcttctggaataatattgtcgaccagttgagacctcatatgcaacgactggatgaattatttatccaactccaacacctgaaagccgtcatcggacctatcgcgttcgtgcagtactacagcacatatctcatcattgcggactgctgcttaattctggtgtcgcatggactgtccagcttctcgatcgtatacttcatctccatgctggtgtttctcaccgagtccttcttgctttgccacggagtggaaaatttaagagacttgaaaccacgcattgcttcgacggtgtacgattttgactggatgttgcaaatgcgctgccctaacccgaggcaccgagctcagtatcgtcacgtacggcgtaccttgctcctgcttacagcccagtccgaccaaacgatacaattcagcttcgccggcatcggcgaaatctcgatgaacagtttcgcccagctcttggagaagagttactctatgctaacgtttttgctgcagttcgcaaagtag

SEQ ID NO: 127 - protein, 418 aa, Anopheles gambiae
MFHPSRWMAKCRVWYAATFKFSADADYFFLVQPLCRSLQLFGNPVRCLQEFGTVRGLFVQLCRFLFLLPYASFALKSYWQLNHPLDTNNSILTYGSFVIYMLWAILIWVLNHYEHEMCELRLFFKNPTYQEQSDWAHRIRAGNYRRWNWMILMFYLFNVINVSIFTLTNAHNRQFHFQTRGEVVGPLYFQIIVEIFTGYLSLGYFVPSCITLMTLQLFRTEMHILTTTLKQAANEEQQQQQHQHAVDIRCAYRSFCKQFYANIRRHTELLQSIATFCKVFSPISVVLYYGALITITCTCFYVMKHDVSTTTVCYAGFAVYMLFNTLLFCKSIDSVNDLHTEVGYIMYSEYWPATLQYADQGLSTETLRPLRRSILIVLQQTLRPLRFGYGVSGSLSMQRFGEFMQQIYSLIMFLAQLN

SEQ ID NO: 128 - DNA, 1257 bp, Anopheles gambiae
atgttccatccatcccgatggatggcaaagtgccgcgtgtggtatgcagcgacatttaagttttctgcagatgctgactatttctttctcgtgcaaccgctctgccgatcgctgcaactgtttggcaatccagtgcgttgcttgcaggagttcggtacggttcgtggcctgttcgtacagctctgtcggttcctgtttttgctaccgtacgcttcattcgcgctaaaatcttactggcagctaaaccatccgttagatactaacaattccatccttacgtatggatcattcgtgatttacatgctttgggcgattctaatctgggtgctgaaccattacgagcacgaaatgtgtgagctaaggctctttttcaagaatcccacctaccaggagcaaagcgattgggctcaccgaatccgtgctggtaattaccgtcgatggaactggatgatactcatgttctatctgtttaacgtcataaacgtgtcgatcttcacgcttaccaacgcccataacaggcagtttcattttcaaacccggggtgaagtcgtgggaccgctgtattttcaaatcatcgtcgaaattttcactggctacttgagcttaggctactttgtaccctcctgcataacgctcatgacacttcagttatttcgaacggagatgcacattttaaccacaacccttaagcaagcggccaatgaagagcagcagcaacagcagcaccaacatgctgtcgacatccgctgcgcataccgttcgttttgcaagcagttttacgctaacattcggcgccacacggaactattgcaatccattgccacgttttgtaaagtatttagccctatcagcgtggtgctgtactatggagctctcattacaataacatgcacatgcttttacgtaatgaagcatgacgtttctacaaccacagtctgctatgcaggatttgcagtttatatgctattcaatacgctactgttttgcaaaagcatcgatagtgttaatgatctgcacacggaggtgggttacattatgtacagcgagtactggccagcgacgctacagtatgcggaccagggcttgtcaaccgaaacactgcgacccttgcgccgcagtatattgatcgttttgcagcaaactttgcgaccgctccgattcggttacggcgtgtccggttccctctcgatgcaaagattcggagaattcatgcaacaaatttactcactgataatgtttctagctcagcttaattag

SEQ ID NO: 129 - protein, 421 aa, Anopheles gambiae
MVKFFRCCKARVSPELLSKKNEKPEAFLPSLRMILFIFRMFYAWPDEQSLAPNALWWYRAKGVLFRTFFIYLSAAAQLAYNFTVTSREELFAGMFVLLTQLVLILKMEFFYKNVSKIQQLIRRLNGKRYQQSGNAEEDMPLVSARKKSTIFWTLYFMFSVGLATEWLVISLSLTTLIVPVWPVVDHTTPYWVYLMVIFHQYVAIALNASFNISWDSLVAALFALTNAHLHRLQIQLMKDAKRRMIAVSSFDDNARSVPTKSDADEVYNELLQCIIFHQEVTGFLREVLDLFSGPLLAQLYCSVFILCITEFRLLTDVNTMADTVQAVIYLLCLVIQVAQYCYFGNEINYMAQKVHRATAFVNYPDMNIKCRKLLIAFQQITAVGIKCSAKYVFTIQLSMETFVTILKTSYSYLAVLRSMTD

SEQ ID NO: 130 - DNA, 1266 bp, Anopheles gambiae
atggttaagtttttccgctgctgcaaagcaagagtgagccctgagctcttaagcaagaagaatgaaaagccggaagcgtttctaccgtcgttgcgtatgattttgttcatttttcgaatgttttacgcgtggccggacgagcaaagtttggcgccaaatgcgctctggtggtaccgtgcaaagggtgtgctgtttcgtacgtttttcatatatctttcagcagcagcgcagctggcttacaacttcacagtcactagtcgtgaggaactgtttgctggcatgtttgtgctgcttacccagctcgtactgatactgaagatggagtttttctacaaaaatgtgtccaaaattcagcagctcatccgaagactgaacggcaagcggtaccaacagtcgggaaatgctgaggaagacatgccgctggtgagtgcgcgcaagaagtcaaccatattctggaccttgtacttcatgttctccgttgggctggctacggagtggttagtgatatcgctgtcgctcaccactttgatagtgccggtgtggcccgtcgtagatcataccacaccgtactgggtatatttaatggtgatcttccatcagtatgtggcaattgctcttaacgcttcgtttaacatctcatgggactcgctcgtggcagcactgttcgcgctcactaacgcgcatcttcatcgactgcaaatacagcttatgaaggatgctaagaggcgtatgattgcggtctcttccttcgatgataatgctcggagcgttccaaccaaatcagatgcagatgaagtatacaacgaactactgcaatgcattatctttcatcaggaagtcactggatttcttcgcgaagtcctcgacctgttcagtggaccgctgcttgcacaactgtactgttccgtgtttatcctgtgcattaccgagtttcgtttgctcacggacgtgaacacaatggcagatacggtgcaggcggtaatttacttgctgtgccttgtcatacaagtggcacaatactgttactttggcaatgaaatcaactatatggcccaaaaggtacaccgagcgaccgcttttgtgaactatccggatatgaacatcaaatgtagaaagcttctaatagcatttcagcagatcactgctgttggaataaagtgtagtgcaaagtatgtttttacaatccaactgagcatggagacatttgtaacgatactcaaaacatcctactcgtatttggcagttttgagatcgatgacggattaa

SEQ ID NO: 131 - protein, 393 aa, Anopheles gambiae
MEASEKFSQFERYIRTLCNIIGFDVMTETWKKSYRTYMSIFLCSQYLILMVYSLIIASDTFELFKSLSFLGFFFQCSLKMYYTIQQAPQYAVNFCCLKEAIYERHSKGTLAQKTTVARIIDLLVLVTKAISVLYTSSLFIFSLYPAYMYFVVHVKVPIFPLYIPGINIYSAYGYGITNSFHMLIAVYGLFGALTSDIVFIMFVVHFVTYGGLFKIECEQFDQDLSGVFQHCEWRTAVYKTFCRQRMRAIYQYHQSVIFYLESMQECYRNICVVQVASCSLSTVFNLFLALTTDWYATYGFIVISVFQLFVYCLMGTVMQIMNERMIDYISNLPWYMLPTEEQKQFKFMLARSQLSAEIMIRSVGPMNMETFTDIMQKMYSAFAMMYSFLVDLG

SEQ ID NO: 132 - DNA, 1182 bp, Anopheles gambiae
atggaggcgtccgagaaatttagccagtttgaacgttatatacgcaccctttgcaacataatcggtttcgatgtaatgaccgaaacgtggaaaaagtcgtaccgaacgtacatgtcgatctttctttgctcacagtacttgatattgatggtttactcgctgatcattgccagcgacacgttcgagctgttcaaatccctctcatttttgggatttttctttcagtgttcgctgaagatgtactacacgatccagcaagcacctcagtatgcggtgaatttttgctgcctgaaggaagcgatctacgagcgtcactcgaaagggaccctagcacaaaagacgaccgttgcccggatcatagatctgttggtgctcgtgacgaaagccatctcagttctttatacttcgtccttgtttattttttcactgtatccggcttatatgtactttgtggtacatgtgaaggtaccgatctttccactgtacataccggggattaacatttactcggcgtacggttatggcatcaccaattcgtttcatatgttgatcgctgtgtacgggttattcggtgcactaacctcagatattgtattcattatgtttgtggtgcatttcgttacttatggggggctgttcaagattgagtgtgaacagtttgaccaggatctgagtggtgttttccagcattgtgagtggcgaacagcagtatataaaacgttctgccgccaacggatgcgcgccatctatcagtatcatcaaagcgttatcttctatctggagtctatgcaggagtgctatcgaaatatctgcgtagtgcaggtggcctcgtgtagtttatcgaccgtattcaatctatttttggccttgacaacggattggtacgcaacgtacggatttattgtgatatctgtgtttcaactgtttgtgtactgcttgatgggaactgtgatgcaaataatgaacgaacgaatgattgattacatctcgaatctgccctggtatatgctcccaaccgaagagcagaagcagtttaagtttatgctcgcacgcagccagctttcagcagaaataatgatccgcagtgtcggtccgatgaacatggaaaccttcactgacattatgcagaagatgtactccgcatttgccatgatgtacagttttctggttgatcttggctag

SEQ ID NO: 133 - protein, 393 aa, Anopheles gambiae
MEASEKFCQFERYLRTLCKIIGFDVMTETWKKSYQTYMSILLCSQYFILMVYSLIIASDTFELFKSLSFLGFFFQCSLKIYYTIQQAPQYAVNFSCLKEAIYERHSKGTLAQKTTITRIIDLLVLMTKAISVLYTSSLFIFSLYPAYMYFVVHVKVPIFPLYIPGINIYSAYGYGITNSLHMVIAVYGLLGALTSDIAFIMFVVHFVTYGGLFKIECEQFDQDLSGVLQHCEWRTVVYKTFCRQRMRAIYQYHQSVIFYLESMQECYRNICVVQVASCSLSTVFNLFLALTTDWYATYGFIVISVFQLFVYCLMGTVMQIMNERMIDYISNLPWYMLPTEEQKQFKFMLARSQLSAEIMIRSVGPMNMETFTDIMQKMYSAFAMMYSFLVDLG

SEQ ID NO: 134 - DNA, 1182 bp, Anopheles gambiae
atggaggcgtccgagaaattctgccagtttgaacgttatttacgtaccctttgcaagataatcggtttcgatgtgatgaccgaaacgtggaaaaagtcgtaccaaacatacatgtcgatcttgctctgttcacagtacttcatattgatggtttactcgctgatcattgctagcgacacgttcgagctgttcaaatccctctcatttttggggtttttctttcagtgttcgctgaagatatactacacgatccagcaagcacctcagtatgcggtgaatttttcctgcctgaaggaagcgatctacgagcgtcactcgaaagggaccctggcacaaaagacgaccattacccggatcatagatctattggtgctcatgacgaaagccatctcagttctttatacttcgtccttgtttattttttcactgtatccggcttatatgtactttgtggtacatgtgaaggtaccgatctttccattgtacataccggggattaacatctactcggcgtacggttatggcatcaccaattcgcttcatatggtgatcgctgtgtacgggttgctcggtgcactgacgtccgatattgccttcattatgtttgtggtgcatttcgttacctatggggggctgttcaagattgagtgtgaacagtttgaccaggatctgagtggtgttttgcagcactgtgagtggcgaacggtagtatataaaacgttctgccgccaacggatgcgcgccatctatcagtatcatcaaagcgttatcttctatctggagtctatgcaggagtgctatcgaaatatctgcgtagtgcaggtagcttcgtgtagtttatcgaccgtattcaatctatttttggccttgacaacggattggtacgcaacgtacggatttattgtgatatctgtgtttcaactatttgtgtactgcttgatgggaactgtgatgcaaataatgaacgaacgaatgattgattacatctcgaatctgccctggtatatgctcccaaccgaagagcagaagcagtttaagtttatgctcgcacgcagtcagctttcagcagaaataatgatccgcagtgtcggtccgatgaacatggaaaccttcactgacattatgcagaagatgtactccgcatttgccatgatgtacagttttctggttgatcttggctag

SEQ ID NO: 135 - protein, 390 aa, Anopheles gambiae
MYTAIEFYNASFNRLKLSSRLIGAGLWEKQEGILWGRVASVMQIVLFLTLHAWTGYKYRYDALQMLETQSLICTGAALMIKYFTMIRNPAPVRELSGNIETQMYTKYQEMSPEYPVVLKYGRVLYIAGHIMIGGYFGSLFIIWINPLIMYFKEGRVMLLFFCEIPYVDWTVMKGYWTTVILQLFFYITGTCGLILVDYLCAYFTINGSLYVDILRFHLDETSELLASPGYQTRNSPEIMAKVSRKWRMCLVEHQRIVEYYDNFSDLWSMINLAQVGCSVFGICINMLIIFLTDWYAAYAILFALFIDLSVHFVLGAIIERKVDDLHISLMHFPWYLMDDRRQKEYKLLLLRAQQPSGMSIAGLTPVNYETYTQIMKMLYQLFALAMNFLK

SEQ ID NO: 136 - DNA, 1173 bp, Anopheles gambiae
atgtacactgcgatcgaattctacaacgccagctttaaccggcttaagctttccagtcggctgatcggtgcgggcttgtgggaaaagcaggaaggcatattatggggtcgggtcgcgagcgtgatgcagatagtgttgtttttgactttgcatgcttggacgggctacaagtatcgttatgatgcgctacagatgctcgagacgcaatcgctcatctgtaccggtgccgcgttgatgatcaagtactttacgatgattcggaatccggccccggtccgtgagctttcgggcaatattgaaacgcagatgtacaccaagtatcaggagatgagccccgagtatccagtggtgctgaagtatggacgggtattgtacattgctgggcacatcatgatcggaggatactttggttcgttgtttatcatatggatcaatccgctgatcatgtattttaaagaaggtcgtgtgatgttgctgtttttctgcgaaattccgtacgtcgattggacggtgatgaaaggctactggactacggttatattgcagcttttcttctacatcaccggaacgtgcggattgattttggtcgattatttgtgcgcatatttcacgatcaacgggtcactgtacgtggacattttgcgctttcatctagacgaactcagcgagctgctagctagtccgggttatcagacgcgcaactcgccggaaattatggcgaaggtgagccgcaaatggagaatgtgtctcgtggagcatcaacgcatcgtagaatattatgataatttttccgacctgtggagtatgattaacctagcacaagtgggttgcagtgtgtttgggatctgcatcaatatgctgattatttttctgaccgattggtatgcggcgtatgcaattttgtttgcactgttcatagacttgtcggtacattttgtgctaggggctatcatcgagagaaaggttgacgatctgcatattagtttgatgcatttcccttggtatttgatggacgataggcgacagaaagaatacaagctgctactattacgtgcgcaacaaccatctggaatgtcgattgctggtctcacgccagttaattatgaaacctacactcagatcatgaaaatgttgtaccaactgtttgctctcgctatgaatttcttaaagtag

SEQ ID NO: 137 - protein, 390 aa, Anopheles gambiae
MATVESFRQLLQPLIFYSKGVGVEIWTAPGKFVPASYYLSLHVAIYFSSTVFTLIKYSDDTLHMMKALITLGTCVQLYVKFIIGHKKASELKLLSDNIEQAILQRYENGKAEEIAVLQRTGRILWFIFRFMRTSVSSAAFGFFLYPVIAYYTTGELMPLFMIELPYYGWTTTIGLAMNMFCQANILVIGTMGAIMSDFLFFMYAMYAMTCIDIFIVHLCELETLLKEIHIHEKECAKQTSIMRQKWIQCMQDHQQATSFLNTTEDIFGITCLAQVLMGIFTVCDGMLLVALTFWFPTYCFLLVMFVELSIYFVIGHFVELKIDEMYNSIISMPWYKLPVEEQKEFAFLMCRQQRPMMLTAYGFLTMNFESYMSVLKGLYQFFVMIMQYVE

SEQ ID NO: 138 - DNA, 1173 bp, Anopheles gambiae
atggcaactgttgaaagttttcggcagctattacaaccactaatcttctactctaagggtgtaggagtagaaatatggactgctcctggaaaatttgtaccagcatcttactatctttcgttacatgtggccatatacttctctagcacggtattcactttgattaagtatagcgacgatacgttgcacatgatgaaggctctaattacgctgggcacttgtgtacagctgtacgtcaagttcatcatcggacataaaaaggcaagtgagctcaagttacttagcgataacattgagcaggctatcctgcagcgctatgaaaatggaaaagcagaggaaattgccgtactgcaacgtactggccgtatactttggtttatttttcgtttcatgcgcacatcggttagtagcgctgcatttggattctttttatatccagttattgcttactatacgaccggggaactgatgcctttgttcatgatcgagcttccctattacggttggacaactaccataggactagcgatgaacatgttttgtcaagcgaatatattggtgattggaacgatgggagctataatgtccgactttctattcttcatgtacgcgatgtatgcaatgacatgcattgatatttttattgtgcacctatgtgagctagagacgctgctaaaagagattcatattcatgaaaaggaatgtgcaaaacaaacatcaataatgcggcaaaaatggattcagtgcatgcaagatcaccaacaagctactagctttctaaatacgactgaagacattttcggaataacgtgtttagcacaagtgcttatgggaatattcacggtctgtgatggaatgctactggtagctttgacattttggtttcctacctattgttttctgttggtgatgtttgtcgagctttcaatttactttgtgattggacattttgtagaactgaagatcgatgaaatgtacaacagtatcatctcgatgccgtggtataaactaccagtggaggaacagaaggaattcgcctttctgatgtgcagacagcaacgccccatgatgttaacagcttatgggtttctcaccatgaacttcgagtcatacatgagtgtattgaagggtctgtatcaattttttgtgatgatcatgcagtacgttgaataa

SEQ ID NO: 139 - protein, 386 aa, Anopheles gambiae
MATIESFRKLLKYLIVYSKVPGVEMWTAPGKFKPASYYVSFHIIVYFVSTVWTLKKYSDDPIHMMKVLITLGTAVQLYIKFFVGHSKSKEVIVFSNKIEQEVFEQNKNRTAGETVLLKQTGYILWFFFRFVTTLATIVVLAFGLYPLFAYNVNGVVMPLFLYELPYYDWSTTIGYVVNMMFQVNLLVIGTIGAMLFDFLYFMYAMYTMVKADIFIIHLGELEKMLNDPLTMKKNQSSVREKWVQCMFEHQQTTNFLNSIEDIFGLMCLAQVSMGVFTICDAMLLVALTDWYPTYSFLLVMFIELSLYFLIGHLIEQKIDAMYNKIISMPWFKLPVKEQKEFRFLMSRQQCPMMLTAYGFHPMNFEAYMSVLKRLYQFFVMVMQYVG

SEQ ID NO: 140 - DNA, 1161 bp, Anopheles gambiae
atggcaaccatcgagagctttcgtaaattgttgaaatatttgatagtgtactcgaaagtgcccggggttgaaatgtggactgcgccgggaaagttcaagccagcctcgtattatgtttcatttcatataatagtatattttgtcagcactgtttggacactgaaaaagtacagtgatgatccaattcatatgatgaaagtccttataacgctgggaactgctgtacagctctacatcaagttctttgtgggacattcaaaatcaaaggaagtgattgttttctctaacaaaatcgagcaggaagtgtttgagcaaaataaaaatagaactgctggagaaactgttctgttgaaacaaactggttatattctttggtttttttttcgttttgttaccacattagctactatcgttgtactagcatttgggctgtatccattgttcgcgtataatgtaaatggagtagtgatgcctttgttcctgtacgagctaccatattacgattggagcactactattggatatgttgtgaacatgatgtttcaagtaaacctgctggtgatcggtacgataggagccatgctgttcgacttcttgtactttatgtacgcgatgtatacaatggtaaaggcggatatttttataatacatcttggtgagctagagaaaatgctaaatgatccgctgacaatgaagaaaaaccaatccagtgtacgggaaaaatgggtgcagtgcatgtttgaacatcagcagactaccaacttcctgaattccatcgaagacattttcgggctcatgtgtctagctcaagtctccatgggagtatttacgatatgcgatgcaatgctactggtagcattgacggattggtatcctacatactcgttcttattggttatgtttatcgaactgtcattatattttttgataggacacttgatcgaacaaaagattgacgcaatgtacaacaagatcatctcaatgccttggtttaagctcccagtgaaggaacagaaagaatttagatttctgatgagcagacagcaatgcccgatgatgttgactgcgtatggttttcatcccatgaatttcgaggcgtacatgagtgtgttgaagcgtctgtaccagtttttcgtcatggtcatgcagtatgttggctga

SEQ ID NO: 141 - protein, 386 aa, Anopheles gambiae
MANVKDFRKLMKSLIVYSKVAGVELWTAPGKFTPASYYVSFHITVYFASTVWTLRKYIDDPIRMMKVLITLGTAVQLYIKFFVWHSKPQEVKLFTAELEQEVLKRYQDGSEEETAVLRHTGRILWIVYRIMSASYIFAAVAFGVYPAFYYFVTGVVMPLFVYELPFCDLSSSLGYAVTMCFQINLLVIGVLGAILSDFVFFMYAIYAMARTEISILHLGELENMLIDPNKNEEHTEDIRRKWVQCMHDHQQSTSFFSTIENLFGLMCLAQVATEFLSICDAMLLVLLTDWYPTYSYLYVMFVQLSGYFVIGHLVEIKIDALYNKIISLPWYKLPVKEQKEFRFLMSRQQYPMMLTAYGFHPMNFEAYMSVLKRLYQFFVMLMQYVG

SEQ ID NO: 142 - DNA, 1161 bp, Anopheles gambiae
atggcaaatgttaaagattttcgtaaattgatgaaatctctgattgtgtactcgaaagtggccggggttgagttgtggacagcaccaggaaagttcacgccagcttcgtattacgtttcgtttcatataacagtatattttgcaagtactgtttggacactaagaaagtacatcgatgatccaattcgtatgatgaaagtcctcataacgctgggaactgctgtacagctctacattaagttcttcgtttggcattcaaaaccccaagaagtcaagttatttaccgctgaactggaacaagaagtgcttaaacgctaccaggacgggtctgaagaggaaactgctgtacttagacatacaggtcgtattctttggatagtctatcgtataatgagtgcgtcatatatcttcgctgcagttgcattcggagtgtatcctgcattttattactttgtaacgggagtagtgatgcctttgtttgtgtacgagctaccgttctgcgatttgagttcttctttaggatacgcagtgacgatgtgttttcagattaatctcttggttattggtgttttgggagcaatactgtctgattttgtgtttttcatgtacgcaatatatgctatggctaggacagagatttcaatattgcatcttggtgagctggaaaacatgcttatcgaccccaataagaatgaagaacacactgaggatatacgtcgcaagtgggtccagtgcatgcacgatcatcagcaatcaaccagctttttcagcacgattgaaaacttattcgggcttatgtgtttagcacaggttgcaacagaatttctttcaatatgtgacgcaatgctattagtgcttttgactgattggtacccaacatattcctacctgtacgtgatgttcgtccaattatcaggatatttcgtgattggacatttggttgagataaagattgacgcattgtacaacaagatcatctcgttgccttggtataaactaccagtaaaagaacagaaggaatttagatttcttatgagcagacagcaatatccgatgatgttgacagcgtatggctttcatcccatgaacttcgaggcgtacatgagtgtgttgaagcgtctgtaccagtttttcgtcatgctcatgcagtatgttggctga

SEQ ID NO: 143 - protein, 388 aa, Anopheles gambiae
MANVEGFRKLMKSLIVYSKVAGVEIWTAPGKFVPASYYVSFHITVYFVSTVWTLRKYIDDPIHMMKVLITMGTAVQLYIKFFVGHSKAQEIMLVTAELEQQVLKRYQNGSEQEIAVLRRTGRILWIVYRMMSASYIFAAVAFGLYPAFYYFATGVVVPLFLYELPFFDLSSSLGYAVTMCFQINLLAIGVLGAILSDFVFFMYAMYAMARADISIVHLRELENILNNPSKNEEHSAELRHKWVQCMHDHQQSTSFFSTIENIFGLMCLAQVATATLSICDAMLLVLLTDWYPTYSYLYVMFVQLSGFFVIGHLVELKIDAMYNKIISMPWYKLPLKEQKEFRFLMSRQQCPMILTAYGFHPMNFEAYMSVLKVLYQFFVMIMQYIDRN

SEQ ID NO: 144 - DNA, 1167 bp, Anopheles gambiae
atggcaaatgttgagggctttcgtaaattgatgaaatcattgattgtgtactcaaaagtggccggggttgagatttggacagcaccaggaaagttcgtgccagcttcgtattacgtttcgtttcatataacagtatattttgtcagtactgtttggacactaagaaagtacatcgatgatccaattcatatgatgaaggtcctcataacgatgggaactgctgtacagctctacatcaaattctttgtgggacattctaaagcccaagaaattatgttagttaccgctgaattggaacaacaagtgcttaaacgttatcaaaatgggtctgagcaggaaattgctgtgcttagacgtacaggtcgcattctttggatagtctatcgtatgatgagcgcgtcatatattttcgctgcagtcgcattcggactgtatccagcattttattactttgcaacgggagtagtggtgcctttgtttctgtacgaactaccgttcttcgatttgagctcttctttagggtacgcagtaacgatgtgttttcaaattaatctgttggcaattggagttctgggagcaatactgtccgattttgtgtttttcatgtacgcaatgtacgctatggctagggcagacatttcgatagtgcatcttagggagctagaaaacatactcaataatccctctaagaatgaagaacactctgcagaattacgtcacaagtgggtccagtgcatgcacgatcatcagcagtcaaccagctttttcagcacaattgaaaacatttttggactcatgtgtttagcacaggttgcaactgcaacattatcaatatgtgacgcaatgcttttggtgcttttgactgattggtatccaacatattcctacctgtatgtgatgttcgttcaactatcagggttctttgtgattggacatttggtagagcttaagattgacgcaatgtataacaagatcatctctatgccttggtataagcttccgttgaaggaacagaaagaatttagatttcttatgagcagacagcaatgtccaatgatactgacggcgtatggctttcatcccatgaacttcgaggcgtacatgagtgtgttgaaggttctgtaccagtttttcgtgatgatcatgcagtatattgacagaaactga

SEQ ID NO: 145 - protein, 388 aa, Anopheles gambiae
MANVEEFRKLMKSLIVCSKVAGVEMWTAPGKLKPASYYVSFHITVYFVSTVWTLRKYIDDPIHMMKVLITMGTAVQLYIKFFVAHSKAQEVKLFTVELEQEVLKRYQNGSEEETAVLRRTGRILWIVHRLMSASYIFVAVAFGLYPAFYYFATGKVMPLFLYELPFFNVSSSLGYAVTMGFQINLLAIGVLGAILSDFMFFMYAMYAMARADISIVHLSELENILNDSTKNEEHSANVRHKWIQCMHDHQQSTSFFSTVENIFGLMCLAQVSTATLSICDAMLLVLLTDWYPTYSYLYVVFVQLSGFFVIGHLVELKIDALYNKIISMPWYRLPVKEQKEFRFLLSRQQCPMILTAYGFHPMNFEAYMSVLKGLYQFFVMILQYIGRN

SEQ ID NO: 146 - DNA, 1167 bp, Anopheles gambiae
atggcaaatgttgaagaatttcgtaaattgatgaaatctctgattgtgtgctcgaaagtggccggggttgagatgtggactgcaccgggaaagcttaagccagcctcgtattacgtttcgtttcatataacagtatatttcgtcagtactgtttggacactaagaaagtacatcgatgatccaattcatatgatgaaggtcctcataacgatgggaactgctgtacagctctatatcaagttctttgtagcacattcgaaagcccaagaagtcaagttatttaccgtggaactggagcaagaagtgcttaaacgctatcaaaatgggtctgaggaggaaactgctgtgcttagacgtacaggtcgcattctttggatagtgcatcgtttgatgagtgcgtcatatatcttcgttgcagtcgcattcggactttatccagcattttattactttgcaacgggaaaagtgatgcctttgtttctgtacgaactcccgtttttcaatgtgagctcttctttagggtacgccgttacgatgggttttcaaattaatctgttggcaattggagttctgggagcaatactgtcagatttcatgtttttcatgtacgcaatgtacgctatggctagggcagacatttcgatagtgcatcttagtgagctggaaaacatacttaacgactccactaagaatgaagaacactctgcaaatgtacgtcacaagtggatccagtgcatgcacgatcatcagcaatcaaccagctttttcagcacagttgaaaacatttttggactcatgtgtttagcacaggtttcaactgcaacattgtcaatatgtgacgcaatgcttttagtgcttttgactgattggtacccaacgtattcttacctgtacgtggtattcgtccaactatcagggttctttgtgattggtcatttggtagagcttaagattgacgcattgtacaacaagatcatatctatgccttggtataggctaccagtgaaggaacagaaggaatttagatttctattgagccgtcagcaatgtccgatgatactgacagcgtatggctttcatcccatgaacttcgaggcgtacatgagtgtattaaagggtttgtaccagtttttcgtgatgatcttgcagtatattggcagaaactga

SEQ ID NO: 147 - protein, 386 aa, Anopheles gambiae
MANVEGFRKLMKSLIVYSKVAGVEIWTAPGKFTPASYYVSFHITVYFASTVWTLRKYIDDPIHTMKVLITLGTAVQLYIKFFVGHSKAREINLFTAKLEQEVLQRYQNGSEEETDVLRHTGRILWLVYRMISASYIFLAVAFGMYPAFYCFATGKVMPLFLYELPFCDWSSSLGYAVTICFQINLLAIGVLGAILSDFVFFMYAMYAMARADISIVHLGELKNMLNDPTKNEERTAEIRRKWIQCMHDHQQSTSFFTMIEHIFGLICLTQVATATFSICDAMLLVILTDWYPTYSYLYVMFVQLSGFFLIGHLVELKNDALYNKVISMPRYKLPVKEQKDFRFLMSRQQNPMMLTAYGFHPMNFEVYMSVLKRLYQFFVMIMQYVG

SEQ ID NO: 148 - DNA, 1161 bp, Anopheles gambiae
atggcaaatgttgaaggttttcgtaaattaatgaaatctctgattgtgtactcgaaagtggccggggttgagatatggacagcaccaggaaagttcacgccagcatcgtattacgtttcgtttcatataacagtatattttgccagtactgtttggacactgagaaagtatatcgatgatccaattcatacgatgaaggtcctcataacgctgggaactgctgtacagctctacatcaaattctttgtgggacattctaaagcccgagaaattaatttatttactgctaaactggaacaagaagtgcttcaacgttatcaaaatggatctgaagaagaaactgatgtgcttagacacacaggtcgcattctttggttagtctatcgtatgataagtgcatcatatatctttctggcagttgcattcggaatgtatccagcattttattgctttgcaacgggaaaagtgatgcctttgtttctgtacgagctaccgttctgtgattggagctcttccttggggtatgcagtaacgatatgttttcagatcaatctgttggcaattggagttctgggagcaatactgtccgattttgtgtttttcatgtatgcaatgtacgctatggctagggcagacatttcgatcgtgcatcttggtgagctaaaaaacatgcttaatgaccccactaagaatgaagaacgcactgcggaaattcgtcgcaagtggatccagtgcatgcacgatcatcaacagtcaaccagctttttcaccatgattgaacacatttttgggcttatttgtttaacacaagtcgcaacagcaactttttcaatatgtgacgcaatgcttttagtgattttgactgattggtatccaacatattcctacctgtatgtgatgttcgttcaactatcaggattctttttgattggacatttggtagagcttaagaatgacgcattatacaacaaggtaatctctatgcctcggtataagctcccagtaaaagaacagaaggattttagatttctcatgagcagacagcaaaacccgatgatgctgacagcgtatggctttcatcccatgaatttcgaggtgtacatgagtgtgttaaagcgtctgtaccagtttttcgtgatgatcatgcagtatgttggctga

SEQ ID NO: 149 - protein, 411 aa, Anopheles gambiae
MTVVHRIVSFGYNLLQRHFNVGHPTEQFFLLRCLDVVSPAMLLQRPRSNLEVALKTLCLSVMVAHTIALAYDFSQQTDVRLAMDMLCMLSLFVSIILRGTCMRQYLAHINALDRLERRPTFRIGTPYADESRRNVALQNSRYLGVALVFHSLTVTVYVIQNMVRENSFVKIITSFPIDLSERAPVLERVADLCYSLVGYVWGWYHGATQLTIIVLLRYAITEFRVFLHSLDSLDDQLQQRREQSQGAPDEERILRELLYEHARHHSQLIVVVTHLRTLLRNYSLVHFSFYMIIVATFMTRVLIIPGRSSFGLAIPLLVTTIYFLETFGMCMLVEMLVQLNRKVSTSLYGFSWPQYLRYGRTIKRPMMLMIMQANMTKDFSAGGLTTVSAELFAKTCRMIYTMMMFMANMAT

SEQ ID NO: 150 - DNA, 1236 bp, Anopheles gambiae
atgaccgttgtgcaccgcatcgttagctttggctacaacctgctccagcgccacttcaatgttggacatcctacggaacagttcttcttgctgcgctgtctggacgttgtatccccggccatgctactacagcgcccacgctcgaatctggaggtcgccctgaagacgctctgcttgagcgtgatggtagcgcacaccatagcgctggcgtacgacttcagccagcagacggatgtgcgtcttgcgatggacatgctatgcatgctgtcactctttgtctccatcattttgcgtggcacctgcatgcgccagtacctggcgcacattaacgcactggaccggctggaaaggcggccaacgtttcgcatcggcacaccgtacgccgatgagagccgccgaaacgttgcgttgcagaacagtcgctacctcggcgtggccctcgtgtttcactcgctcacggtaacagtctacgtgatccagaacatggtgagggaaaattcgttcgtgaagatcattaccagcttcccgatcgacctgtccgagcgggcaccggtgctggagcgggtggccgacctgtgctacagcctcgtcgggtacgtttggggttggtaccatggggccacccagctaaccatcatcgtcctgctgcgctacgccattaccgagtttcgcgtgtttctccactcactggacagcctggacgatcagctacaacagcgtcgcgaacagtcgcagggagctccggacgaggagcgcatcctgcgggagctgctgtacgagcacgcacggcaccactcgcagctgatcgtggtcgtgacgcacctgcgtacgttgctgcgcaactactcgctagtgcacttctccttctacatgatcatcgtggccacctttatgacgcgcgtccttatcatccccggcaggtcgtcgttcggcttggccatcccgctgttggtgacgacgatctatttcctcgaaacgttcggcatgtgcatgctggtggagatgctggtgcagttgaatcgaaaggtcagcaccagcttgtacggattcagctggccccagtatctgcgctacggacgcaccatcaaacggccgatgatgctgatgataatgcaggcaaacatgacgaaagatttctccgccggcgggctgaccacggtatcggccgagctgtttgctaaaacgtgccgaatgatctacaccatgatgatgtttatggccaatatggcaacgtag

SEQ ID NO: 151 - protein, 411 aa, Anopheles gambiae
MTVVHRIVSFGYNLLQRHFNVGHPTEQFFLLRCLDVVSPAMLLQRPRSNLEVALKTLCLSVMVAHTIALAYDFSQQMDVRLALDMLCMLSLFVSIILRSTCMRQYLSHIDALDRLERRPTFRVGTPYADESRRNVALQNSRYLGVALVMHSLTVTMYVIQNMVRENSFVKIITSFPIDLSERAPVLERVADLCYSLVGYVWGWYHGATQLTIIVLLRYAITEFRVFLHSLDSLDDQLRQRREQAQGAPDEERILRELLYEHARHHSQLIVVVTHLRTLLRNYSLVHFFFYMIIVATFMTRVLIIPGRSSFGLAIPLLTTTIYFFETFGMCMLVEMLVQLNRKVSTSLYGFSWPQYLRYGRTIKRPMMLMIMQANMTKDFSAGGLTTVSAELFAKTCRMIYTMMMFMANMAT

SEQ ID NO: 152 - DNA, 1236 bp, Anopheles gambiae
atgaccgtagtgcaccgcatcgttagctttggctacaacctgctccagcgccacttcaatgttggacatcctacggaacagtttttcttgctccgctgtctggacgttgtatccccggccatgctactacagcgcccacgatcgaatctggaagtcgccctgaagacgctctgcttgagcgtgatggtagcgcacaccatagcgctggcgtacgacttcagccagcagatggatgtgcgacttgcgctggacatgctatgcatgctgtcactctttgtctccatcattttgcgtagcacctgcatgcgccagtacctgtcgcacattgacgcactggaccggctggaaaggcggccaacgtttcgcgtcggcacaccgtacgccgatgagagccgccgaaacgttgcgttgcagaacagtcgctacctcggcgtggccctcgtgatgcactcgctcacggtaacgatgtacgtgatccagaacatggtgcgggaaaattcgttcgtgaagatcattaccagcttcccgatcgacctgtccgagcgggcaccggtgctggagcgagtggccgacctgtgctacagcctcgtcgggtacgtttggggttggtaccatggggccacccagctaaccatcatcgtcctgctgcgctacgccattaccgagtttcgcgtgtttctccactcgctggacagcctggacgatcagctgcggcagcgtcgcgagcaggcgcagggagctccggacgaggagcgcatcctgcgggagctgctgtacgagcacgcacggcaccactcgcagctgatcgtggtcgtgacgcacctgcgtacgttgctgcgcaactactcgctagtgcatttcttcttctacatgatcatcgtggccacctttatgacgcgcgtccttatcatccccggcaggtcgtcgttcggcttggccatccccctgttgacgacgacgatctatttcttcgaaacgttcggcatgtgcatgctggtggagatgcttgtgcagttgaatcgaaaggtcagcaccagcttgtacggattcagctggccccagtatctgcgatacggacgcaccatcaaacggccgatgatgctgatgataatgcaggcaaacatgacgaaagatttctccgccggcgggctgaccacggtatcggccgagctgtttgctaaaacgtgccgaatgatctacaccatgatgatgtttatggccaatatggcaacgtag

SEQ ID NO: 153 - protein, 386 aa, Anopheles gambiae
MGTANQPTSICFLRWIGWMDTINGIHLHDDSRLARAFEYTFYALQLVQLLNGYNFAVLCSNDTISLETFAEQFNQFGGILLTLSRVIAIVGSFPRLKDTAEFINACKFHHLNERAEEIRAGSIHNAGRFLSTLLAVQIVTLIFWFVLTELQAHRQDVLLPIFIYLPFDASHWPLVAKVAFRLYAYVAFAYAQLMLTFFGSYIITSSYLLTLTIELRILNDSYAAAPTDPQQLVAFLKERVVYKAALLQHIRTIKRHMNGSVLLELLFIVCLLALNGLRLCTTTTTSDLSELALSSSMILIYLLELFQYCWQVDEMELLHEGQAFAVYSTPWTGAIMQSKPFLLITIRMAQVPLRFMCGRMYQLSTELFTSVVQFIYSLIMMLLQFK

SEQ ID NO: 154 - DNA, 1161 bp, Anopheles gambiae
atgggtacggcaaaccaaccaacaagcatctgcttccttcgatggatcggctggatggacacgatcaacgggatccatctgcacgacgattcgcgcctagctcgggcgttcgagtacacgttttacgcccttcagctggtgcagcttctgaatgggtacaatttcgcagtgctttgcagcaacgacaccatctcgctcgaaacgtttgcggaacagttcaaccagttcggtggtattttactgaccctgtcccgtgtcatcgcgattgtaggcagctttccgcgcctgaaagacacggccgagttcatcaatgcctgcaaatttcaccatcttaacgagcgagcagaagagatccgtgccggatccattcacaacgcgggccgattcctgtccacgctcctagccgtccagatagtaacgcttattttctggttcgtgctaactgagctgcaggcccaccggcaggacgtgctgctgcccatattcatctatctaccgtttgacgcttcccactggccactagtcgcaaaggtagcgtttcggctgtacgcttacgtagcgtttgcgtacgctcagctgatgcttacgttcttcggaagctatatcatcacgagcagctacctgctaacgcttaccatcgagcttcgcatcctgaacgattcgtatgctgctgcaccgaccgatccgcagcagttagtagcattcctgaaggaacgggtcgtctacaaggcggcactgctgcagcacatccgaaccatcaagcgacacatgaacgggagcgttctgctggagctgctgtttatcgtgtgcctgcttgcgctcaatgggttacgcctgtgcaccaccaccaccaccagtgatcttagcgagctggcactgtccagcagcatgatcctgatctatctgctggagctgttccagtactgctggcaggtggatgagatggagctgctgcacgagggtcaagcgttcgccgtctactcaacgccgtggacgggtgccatcatgcagtcgaaaccattcctgctgatcacgatccgtatggcccaggtgccgttgcgcttcatgtgcggtaggatgtatcaactgtctaccgagctgtttacctccgttgtgcagtttatctactcactcattatgatgcttttacagtttaagtaa

SEQ ID NO: 155 - protein, 412 aa, Anopheles gambiae
MTVVHRIVSFGYNLLQRHFNVGHPTEQFFLLRCLDVVSPAMLLQRPRSNLEVALKTLCLSVMVAHSIALAYDFSQQTDVRLAMDMLCMLSLFVSIILRGTCMRQYLAHIDALDRLERWPTFRVGTPYADESRRNVALQNSRYLGVALVMHLLTVTVYVIQNMVRENSFVKIITSFPIDLSERAPVLERVANLCYSLVGYVWGWYHGATQLTIIVLLRYAITEFRVFLHSLDSLDDQLRQRREQSQGAPDEERILRELLYEHARHHSQLIVVVTHLRTLLHNYSLVHFFFYMIIVATFMTRVLIIPGRSSFGLAHPPVDDDDLFLSKTFGMCMLVEMLVQLNRKVSTSLYGFSWPQYLRYGRTIKRPMMLMIMQANMTKDFSAGGLTTVSAELFAKTCRMIYTMMMFMANMAT

SEQ ID NO: 156 - DNA, 1239 bp, Anopheles gambiae
atgaccgtagtgcaccgcatcgttagctttggttacaacctgctccagcgccacttcaatgttggacatcctacggaacagtttttcttgctgcgctgtctggacgttgtatccccggccatgctactacagcgcccacgttcgaatctggaggtcgccctgaagacgctctgcttgagcgtgatggtagcgcactcaatagcgctggcgtacgacttcagccagcagacggatgtgcgtcttgcgatggacatgctatgcatgctgtcactctttgtctccatcattttgcgtggcacctgcatgcgccagtacctggcgcacattgacgcactggaccggctggaaaggtggccaacgtttcgcgtcggcacaccgtacgccgatgagagccgccgaaacgttgcgttgcagaacagtcgctacctcggcgtggccctcgtgatgcacttgctcacggtaacagtctacgtgatccagaacatggtgagggaaaattcgttcgtgaagatcattaccagcttcccgatcgacctgtccgagcgggcaccggtgctggagcgggtggccaacctgtgctacagcctcgtcgggtacgtttggggctggtaccatggggccacccagctaaccatcatcgtcctgctgcgctacgccattaccgagtttcgcgtgtttctccactcgctggacagcctggacgatcagctgcggcagcgtcgcgagcagtcgcagggcgccccggacgaggagcgcatcctgcgggagctgctgtacgagcacgcacggcaccactcgcagctgatcgtggtcgtgacgcacctgcgtacgttgctgcacaactactcgctagtgcacttcttcttctacatgatcatcgtggccacctttatgacgcgcgtccttatcatccccggcaggtcgtcgttcggcttggcccatccccctgttgacgacgacgatctatttctttcgaaaacgttcggcatgtgcatgctggtggagatgctggtgcagttgaatcgaaaggtcagcaccagcttgtacggattcagctggccccagtatctgcgctacggacgcaccatcaaacggccgatgatgctgatgataatgcaggcaaacatgacgaaagatttctccgccggcgggctgaccacggtatcggccgagctgtttgctaaaacgtgccgaatgatctacaccatgatgatgtttatggccaatatggcaacgtag

SEQ ID NO: 157 - protein, 384 aa, Anopheles gambiae
MGTANQPSSICFLRWIGWMDTINGIHLHDDSRLARAFEYTFYALQLVQLLNGYNFAVLCSNDTISLETFAEQFNQFGGILLTLSRVIAIVGSFPRLKDTAEFINAYKFHHLNERAEEIRAGSIHNAGRFLSTLLAVQIVTLIFWFVLTELQAHRQDVLLPIFIYLPFDASHWPLVAKVAFRLYAYLAYAQLMLTFFGSYIITSSYLLTLTIELRILNDSYAAAPTDPQQLVAFLKERVVYKAALLQHIRTIKRHMNGSVLLELLFIVCLLALNGLRLCTTTTTSDLSELALSSSMILIYLLELFQYCWQVDEMELLHEGQAFAVYSTPWTGAIMQSRPFLLITIRMAQVPLRFMCGGMYQLSTELFASVVQFIYSLIMMLLQFK

SEQ ID NO: 158 - DNA, 1155 bp, Anopheles gambiae
atgggtacggcaaaccaaccatctagcatctgctttcttcgatggatcggctggatggacacgatcaacgggatccatctgcacgacgattctcgcctagctcgggcgttcgagtacacgttttacgcccttcagctggtgcagctgctgaatgggtacaatttcgcagtgctttgcagcaacgacaccatctcgctcgaaacgtttgcggaacagttcaaccagttcggtggtattttactgaccctgtcccgtgtcatcgcgattgtaggcagctttccgcgcctgaaagacacggccgaattcatcaatgcctacaaatttcaccatctcaacgagcgcgcagaagagattcgtgccggatccattcacaacgcgggccgattcctgtccacgctcctagccgtccagatagtaacacttattttctggttcgtgctaactgagctgcaggcccaccggcaggacgtgctgctgcccatattcatctatctaccgtttgacgcttcccactggccactagtcgcaaaggtagcgtttcggctgtacgcttaccttgcgtacgctcagctgatgctgaccttcttcggaagctatatcatcacgagcagctacctgctaacgcttaccatcgagcttcgcatcctgaacgattcgtatgctgctgcaccgaccgatccgcagcagttagtagcattcctgaaggaacgggtcgtctacaaggcggcactgctgcagcacatccgaaccatcaagcggcacatgaacgggagcgttctgttggagctgctgtttatcgtgtgcctgcttgcgctcaatggtttgcgcctgtgcaccaccaccaccaccagtgatcttagcgagctggcactgtccagcagcatgatcctgatctatctgctggagctgttccagtactgctggcaggtggatgagatggagctgctacacgagggtcaagcgttcgccgtctactcaacgccgtggacgggtgccatcatgcagtcgaaaccattcctgctgatcacgatccgtatggcccaggtgccgttgcgcttcatgtgcggtgggatgtatcaactgtctaccgagctgtttgcctccgtggtgcagtttatctactcactcattatgatgcttttacagtttaagtaa

SEQ ID NO: 159 - DNA, 1725 bp, Anopheles gambiae
atgaagctgaacaaactgaacccacggtgggatgcgtacgatcgacgggattcgttctggttgcagttgctttgtttgaaatatttaggcctatggccaccggaagatacggatcaggcaacgcggaaccggtacatcgcgtacggttgggctttgcggatcatgtttctacatctgtacgctctaacgcaagccctatacttcaaggatgtgaaggatattaatgtgagtctctagttagctattagtgttccacctgtccataatctgtcttttattgggtaggacatcgcaaatgcattgttcgtgcttatgactcaagtgacgttgatctacaagctggaaaagtttaactacaacatcgcacggattcaggcttgtctgcgcaagcttaactgcacactgtatcacccgaaacagcgcgaagaattcaggtaagcctgctgggaaatatgactaaaaagagtgctaacaaacgactctcctccaaatgtagccccgttttacaatcgatgagtggagtgttttggctgatgatctttctcatgtttgtggctatcttcaccatcatcatgtgggttatgtcgccagccttcgacaatgaacgtcgtctgcccgtgccggcctggttcccggtggactatcaccattcggacatagtgtacggtgtactgttcctgtatcaaaccattggaatcgtcatgagcgcaacgtacaacttctcgaccgataccatgttttccggcttgatgctacacataaatggacaaattgtgcggcttggtagtatggttaaaaaggtgagttacggcgactacttgcctccagtaaggacagggagtttgtttccgttatgatatcattttatcagcttggacatgacgtccctcccgaacgccaattggtcgcaacggatgcggaatggaaagagatgcgaaagcgcatcgaccatcactccaaagtgtacggtacgatgtacgctaaagtaacggagtgtgtgctgtttcacaaggacatcttaaggtacgaattgggccaattaattgtgtcatttaaaaagcttgacccaacttttcacagcttcggcgatgaagtgcaggacattttccaaggatctatcttcgcgcaagtatgcgcgtctgtaattatcatttgtatgacactgctgcaagctaccggggacgatgttacgatggccgatctgctgggctgtgggttctatttgctagtaatgacatcgcaagtgtttattttctgttacgtagggaatgaaatctcctatacggtaggttggacacgtagaggaattaaatgtttgggaagaatatcaataccaaatagtatgatgtttcgttacagacggataaatttacagagtttgttgggttttccaactacttcaagttcgataagcgtaccagccaagcaatgatattttttctgcaaatgtgagatagcggtgtatttgtgcagtcagtacattaaatacgttctctatttcaggactcttaaagatgttcacatcaaggtgggaagtgtcttgaaggttacgctaaatcttcacacatttttgcaggtatgtaattatgctgtggtatttagcttgaaataagctacaaactttgaaagtaatttcaatctgttttgtagattatgaagctatcgtactcctatctggccgtacttcagagcatggaatcagagtaatggtgttaatatccttaa

SEQ ID NO: 160 - DNA, 3089 bp, Anopheles gambiae
atgctgatcgaagagtgtccgataattggtgtcaatgtgcgagtgtggctgttctggtcgtatctgcggcggccgcggttgtcccgctttctggtcggctgcatcccggtcgccgtgctgaacgttttccagttcctgaagctgtactcgtcctggggcgacatgagcgagctcatcatcaacggatactttaccgtgctgtactttaacctcgtcgtacgtgggcgaggggaggggcaataaccttcccacttggtggatattttcataccttttccatgtgtttttttattctctgtttgttgccatccagctccgaacctcctttctcgtgatcaatcgacggaaatttgagacattttttgaaggcgttgccgccgagtacgctctcctcgaggtaagtcattggtttttctagtttttgggggagttgtttacaccataaccacccccgacggtaacatttgatcgtcccgcgaaaatgtttgtacagaaaaatgacgacatccgacccgtgctggagcggtacacacggcggggacgcatgctatcgatatcgaatctgtggctcggcgccttcattagtgcctgctttgtgacctatcctctgtttgtgcccgggcgcggcctaccgtacggcgtcacgataccgggcgtggacgtgctggccaccccgacctaccaggtcgtgtttgtgctgcaggtttaccttaccttccccgcctgctgcatgtacatcccgttcaccagcttctacgcgacctgcacgctgtttgcgctcgtccagatagcggccctaaagcaacggctcggacgcttggggcgccacagcggcacgatggcttcgaccggacacagcgccggcacactgttcgccgagctgaaggagtgtctaaagtatcacaaacaaatcatccagtaagtagacgctagtagactcgaccggattgcccttccctcggggaggggaggtttgctatttcgggatgcggcagcacgcatacacacaaaccggaagccattaattctcccgttttcatgcccgcacgggcactgggtcatgtttcacatccttccttcctttccaaacacacacacgcgcgcgtgcacgtacagatatgttcatgatctcaactcactcgtcacccatctgtgtctgctggagttcctgtcgttcgggatgatgctgtgcgcactgctgtttctgctaagcattgtaagtaaaatcgaccgacgtgcggtcgctagtccgtctccggactctcatttcgggactcaatcgttccatctctcaatagagcaatcagctggcacagatgataatgattggatcgtacatcttcatgatactctcgcagatgtttgccttctattggcatgcgaacgaggtactggagcaggtaatggcgctgaagctgagtttggttgagcggttcgctatagatcggctgtcttacattgttgtgtttctgcatggggatcggttttgtttttcctctccatttcagagcctaggcattggcgatgccatttacaatggagcgtggccggactttgaggaaccgataaggaaacggttgattctaattattgcacgtgctcagcgaccgatggtggtaagtttggctgatcgatgctctgttcaatgaacatggcacagaaggctgtgtaaatagctgttcattaataagttttttcagaatgtatcgtttttagttgatttaaacgcattgttctatgcaatggtagcaacaatagaccgcctttattaatccaagcttcctttaggattgatttttattttaagagaaagataaaccatttttagtaaccaatttagttacaggaaccaaaatacagaatttattattattattattattattattattattattattattattattattattattattattattattattattattattattattataattattattattattattattattattattattattattattaatattattattattattattattattactattattattataattattacttttattattattattattattattattattattattattattattattattattattattattataattatgattattattattattattattattattattattattataacaataataattattattattatttattattaattaattaatttattattattaattattattattgttattcattattatacattattatcataataataattttattatgattattattattattattattattattattattattattattattattcttattattattattattattattattattaatattatttttaatattattattattattattactattcttattataattatttttttttattattattattattattattattattattattattattattattattgctattgttattattattcttattattgctattgttattattattattcttattattgttgttgttgttgttcttattattgttgttgttgttattcttattattgtttattattattgtttttttttattctctaattattccagtaatccataataaaaaataataaagtaaataaatagtaaatagtaaataattccagtaactgtagtaatacacaataatctctaagaattaaaattgcattttgtaatgaaatatgttgattgttcgaatagttcagaaaaacttaaaaatgcctcagcattaaacagttttgaggttgttcagggcatttagtttagatattttagtattttaaagcatttgttttcattactacaaaaaagcaaatttatgagtgaattactttcagttcttctaaacgcctatgtgtatgcaattacataacaatagctctcttttttattgcatttttccttagtaatctaaatccaatctcttctttccctcttgcagattaaagtcggcaacgtgtacccgatgacgttggaaatgtttcaaaaattgctcaacgtgtcctactcctatttcacactgctgcgccgagtgtacaactaaacttaaccggtaa

SEQ ID NO: 161 - DNA, 1573 bp, Anopheles gambiae
atgccttctgagcggcttcgtctcattacttccttcggaactcctcaagacaaacgcacgatggtactgccaaaattaaaggatgaaacagcagtgatgccgtttctgctgcaaattcaaaccattgccggactgtggggtgaccgttcccagcggtaccgtttttatctcatcttttcctacttctgcgcgatggtggttctacccaaagtgctgttcggttatccagatctcgaggttgcggtacgcggcacggccgagctgatgttcgaatcgaacgcattcttcggcatgctaatgttttcctttcaacgcgacaactacgagcgattggtgcatcagctgcaggatctggcagctctaggtgagtatgcagccaatcgattgttccaaaccttcgcaacatccttcgtaacactgctacactttcagtcctccaagacctacccacagagctgggagagtacctgatctcagtgaaccgacgggtcgatcggttctccaaaatttactgctgctgtcacttttccatggcaacgttcttttggttcatgcccgtctggacgacctattccgcctactttgctgtgcgcaacagcacggaaccggtcgagcacgtgttgcacctcgaggaagagctgtacttcctgaacattcggacttcgatggcgcactatacgttttatgtggccattatgtggcccacgatctatacgctcgggtttaccggtggcacaaagctgctgaccattttcagcaatgttaagtactgttcggccatgctgaagctcgttgcactccgaatccactgtctagcgagagtagcgcaagaccgagcggaaaaggagctgaacgagattatttccatgcatcagcgggtactcaagtaagtaaattcaaattgaaagttttgcagggaataacttgagtgtgtctgacccgtgcacatcctagctgcgtgttcctgctggagacgacattccgctgggtatttttcgtgcagttcattcagtgtacaatgatctggtgcagtctcatcctctacatagcggtgacggtaatagcattttcgtcatttcgttagccttattcaatccatttttgtgaacgtgaatttcccccaggggttcagctcgacggtagcgaatgtatgtgtccagatcattttggtgacggtggaaacttacggctacggctacttcggaacagatctaaccacggaggtgctttgggtaccctttggatgaagcttcaaaaagtaattccaaattctgttttcgatttttccccttttccactagagctatggcgttgccctcgccatttacgatagcgagtggtacaagttttccatttcgatgcgccgcaaacttcgactgctactgcaacgatcccaaaaaccgctcggcgtaacggcgggaaagtttcgcttcgtcaatgtggcccagtttggcaaggtaacattaattacagtttgaaaattctgaagaatgcatcttacttgccttacttgttgttccagatgctcaagatgtcctattcattttacgtagtactgaaggagcagttttag

SEQ ID NO: 162 - DNA, 1318 bp, Anopheles gambiae
atgaagtttgaactgtttcaaaaatattcctccccggacacggtcttatccttcgtgctaaggcttttgcatatcgtgggcatgaatggggcaggatttcggtcgcgaattcgagttggtggcatttttctgttctatttaatctttcttgtaataccgccactaacgggcgggtacaccgatggtcaccagcgtgtacgcaccagtgtggaattcctgtttaattgcaatatttacggcggcagtatgttctttgcctacgatgtggccactttccaagcgttcatccaggaactgaagagcctttcggttttgggtaatatttaattaattaaaattgcgtttattgcatcatcatttgtttctctttgcagtatgctcacattcgtacagactaaagtataagctgacccggttcaaccgtcgagcggatattatcgccaaagtgcaaacgacctgcatgggtgctgtaacgcttttctactggattgcaccgataccttccatctgtgcgcactactacaggtcgaccaattccaccgaacccgtgcggtttgtgcaacatttagaggtgaagttctattggctcgagaatcgcacctcagtcgaggactacataaccttcgtgctgatcatgctacccgtcgtggttatgtgtggttacgtatgcaatttgaaggtgatgaccatctgctgcagcattggacactgtacactgtacaccaggatgactatagagatggtagagcagttggaaagcatggcatcagcggaacgaactgccagcgccatacgcaacgtggggcagatgcacagtggtttactgaaatgcattaggcttttgaacacgtcaatccgatcgatgctgatgctgcagtggttgacctgcgtgttaaactggagcatttctctcatctatctaacgaacgtggttagttttgtcttgtttggaaatccaaaaacaaaaagatggctataattgaactttctattacagggcatctcgctacaatcggttaccgtggtggtaatgttttttcttgccactgcggaaactttcctgtattgtttacttgggacgcggcttgcgacacaacagcagctgctggagcacgcactctatgctacacggtggtacaactacccaatagcctttcgcagcagcattaggatgatgttgagacagtcgcaaaggcatgcacacataacggtggggaagttttttcgcgttaatttggaagaatttagcaggattgtcaacttatcctactctgcttacgtcgtacttaaggatgtaataaagatggatgtacagtga

SEQ ID NO: 163 - DNA, 1493 bp, Anopheles gambiae
atggtgctaccgaagctgtccgaaccgtacgccgtgatgccgcttctactacgcctgcagcgtttcgttgggctgtggggtgaacgacgctatcgctacaagttccggttggcatttttaagcttctgtctgctagtagttattccgaaggttgccttcggctatccagatttagagacaatggttcgcggaacagctgagctgattttcgaatggaacgtactgtttgggatgttgctgttttctctcaagctagacgactatgatgatctggtgtaccggtacaaggacatatcaaagattggtgcgtgataatgattgataaaaggaacctttgagcaactcctatccctttcaagctttccgtaaggacgttccctcgcagatgggcgactatctggtacgcatcaatcatcgtatcgatcggttttccaagatctactgctgcagccatctgtgtttggccatcttctactgggtggctccttcgtccagcacctacctagcgtacctgggggcacgaaacagatccgtcccggtcgaacatgtgctacacctggaggaggagctgtactggtttcacacccgcgtctcgctggtagattactccatattcaccgccatcatgctgcctacaatctttatgctagcgtacttcggtggactaaagctgctaaccatcttcagcaacgtgaagtactgttcggcaatgctcaggcttgtggcgatgagaatccagttcatggaccggctggacgagcgcgaagcggaaaaggaactgatcgaaatcatcgtcatgcatcagaaggcgctaaagtaaggtctgccggtatgttgtggatagaatacatttctagctgctttcagatgtgtggagctgttggaaatcatctttcggtgggtttttctgggacagttcatacagtgcgtaatgatctggtgcagcttggttctgtacgtcgccgttacggtaactaaaagcactgtagtgatctgtctgccacaccattcactgctgtgtcttgttttgtcactcttcccagggtctcagcacaaaagcggcaaacgtgggtgtactgtttatactgctaacagtggaaacctacggattctgctactttggcagtgatcttacctcggaggcaagttgttattcgctgagtttcagttacttttccgttcccctctaaccgtaccacttgtaccatttgtttgagacagagcttgagcgtagcacgtgctgcgtacggtagcctctggtatcgccgttcggtttcgattcaacggaagcttcgaatggtactgcagcgtgcccagaaaccggtcggcatctcggctgggaagttttgcttcgtcgacattgagcagtttggcaatgtatggggagaccttccactgtggcaagaaagattttctttattaatgcatcttttaatttacagatggcaaaaacatcatactcgttctacatcgttctgaaggatcaattttaa

SEQ ID NO: 164 - DNA, 9252 bp, Anopheles gambiae
atggtgctgatccagttcttcgccatcctcggcaacctggcgacgaacgcggacgacgtgaacgagctgaccgccaacacgatcacgaccctgttcttcacgcactcggtcaccaagttcatctactttgcggtcaactcggagaacttctaccggacgctcgccatctggaaccagaccaacacgcacccgctgtttgccgaatcggacgcccggtaccattcgattgcgctcgccaagatgcggaagctgctggtgctggtgatggccaccaccgtcctgtcggttgtcggtatgtgtgtatgtgtgtggccgtttgggaaagtgtctttgcggcagaaccccaatctactgttacgcttgactgggtttttgtttttttctcggtggagggacgggataaaatatctgaaagaataattgagtcaacccacagggggatgcaagacatcgcaggcagagagtttgggtttgatttatcaccgcacaccgaatatcttcacggttcataagcttcaccgcggtgaaaagggaactccccatttccctgttttcttttttttcttcctctcgataaattactcatcgcttttcgtttttttttttttgttgttgcttctttcttctttcatccctactagcctgggttacgataacatttttcggcgagagcgtcaagactgtgctcgataaggcaaccaacgagacgtacacggtggatataccccggctgcccatcaagtcctggtatccgtggaatgcaatgagcggaccggcgtacattttctctttcatctaccaggtacgttggcggaatgtcctgcgcgtcacagttggcagtcagtgagcggcaacacggcgaaaaaatgggactaaaaccggtcttcacagagccaacacattcctacagcaattgcataccttcgggcggtcgggactgggcaatgcagctacaacatcctcgcctaaagttatgcaattcgagcgacaaatgttgccgtgttagggctttttgtgataatagtcgtttttttgtcctctcgcttatcaaactctatcaacggaggaaatccattttcgctacaatgcctacagctcaagtttcaaggtcaatcgagcgggtggggatcaacttttttattcattttgctaacgccccatcaacaaattctatgttctcaatggcaaagattactgcccgcaccaatcgcccaacgaaacggcaaaagaaaagcgacgattatgaagatgtccaaaccattgcccgcccgacgctttatctgatgatttgcgggatggcttttacttgtctgctactttcaggcacaaaaggaaatgaaaccagcgcaggctcgtttgccggcttgcggaggttcttcaggcactgaggctgagtacttaaatcgaacgatttttacgattctggatccagttttatgatgtggcctgcattacagtggcaattataccctgatgttcatttcattgcattttgtaagtttgtgctggtaacgcccgtaacgattaattcttttcaaagagattctttcaaagagattcaaaatgtgtataacaaatgctaacgaatggaccgtacttggagggttgcggaaagtaacgttttaaaatattcatcacaatcctctgcaaacttgtgcttaattaattggtgcacaataagtttaaactgtggcggcagatgtgtcgctgtccgcttccttccttcccagcaagctcgtgcgaaataatttattccatcattttaatacagccgtttgtgcattttaattagcaaagcaatataaaaagcagctaaccatccccattaaaacaaagtgcttccgggcccaattgttatggcggtggaaagtaatggttttaccagtggaagtgtcctttcccatcgtgggtacttcgcgatattcttgtcttatacaagtgcatacagaaaaaaaggacaaatcctccttgctatggtctaaggccagcttcggtaccgcttccgcttcgggatgtcataaagtttgatgggtgtttttaacattacttccgctcttaaccacctaatggacttttcatgcttgagctaaagttaaaccagccaccagcggtacgcaccgagccacggttgatttcggcggcggcctcatccccagttttgcgccaccaatattgccttcattaatctgtaccctcggagcgttagggcccgcggacgagtcctcgttgtaatgcaccgccatgccacgggacgggataatccgttgggacggcgcgaaagcgactatcgcggacggattggttcgaccgtgctacaacacattttatgcttcacagatttacttcctgctgttttcgatggtccagagcaacctcgcggatgtcatgttctgctcctggttgctgctagcctgcgagcagctgcaacacttgaaggtaggtacggtagcaaacgtggttgtctttacatccgcgtgcagcattatccttatcgacgtgtagtgttaacggtaaaagaggaagcgataaaaaagcaacattctctcacaccctcgatctctctttattttctctctctctctctctctctctctctctctctctctctctctctctctctctctccatctcctcgggcagggtattatgcgatcgttgatggagctttcggcctcgctggacacctaccggcccaactcttcgcaactgttccgagcaatttcagccggttccaaatcggagctgatcatcaacgaaggtatgtgaaacgtgtgctcgtggcagacggactcaaagagagcataacacaatcccctggtagttcatttcaatgaccttaacactcggcaagctaagcgagacagtggggacagtgagaaagagagaacaagaaaaaaaaccatcatccgtacgacatcatcgctacgtaccggtatttcaggatgaggaaataaaacgctaggggaatgaaagtgcgacagaatgataaaacaatccccacccaggcccccagcctggacgaacggatgtagtgtgcgaagcgagcaaaaaaagtcaaataaattgaagtttaaaaatagattttccccgtccatccgtggtggagcgtaaagcccggcggacaacttcgagcacggcgaccgtgcacagtactgtgccacagttgtagggacggataagctccgttccttttttatcctttttttttggagatttgtttgcgttcgcatcgttagacgagcttagtgccgtgttgctctaattgctatttattataaagcgcttccaaatagaagatcggttctctccatttaatctatcgcgcctgtacgcctgaaactatgcactgtgctgtgaaaccgtcaagctcgagcacgacgaatggcccaccgtaccacgcccgtggtgcccaaagcgcaacgcgaattgcatgttaacaaacctttgcctaccatccaatccgtgtgaaattgcccgctctctttctctcttttgcgctttcggtgtatcgaacggttttgtcccttttttttactttgctcttgatctcttgctgtgctcactttcatctcatgttttgcctgacggtggtgggttttcgaaaaaagagcgatttcttctgcgtgtgtgtgtggtttttttaaataaccgctccaggtcgtgttgaacgctgcaggaccgatcggagctagtttattatcagctttagtgtttatcccacccatgccccacatcacgtctgtggagagtgggggaagcttaagtccaatgtaatttaccgtgtttctgtcgttcgtcaccttcttcgtcgatggagattggtgcggttggcacgataaaagcccactgcacgttacggaccgagggaaaggtctttttgtaggcctagcaacggtcctcattcaccgcatgggggtgtagctcagatggtagagcgctcgcttagcatgtgagaggtaccgggatcgatacccggcatctccaacccacacaaaacgttttttaagaagatttttagggaagatattaacgcgggtacactgtgctcctctaagttggaagagtagatgagatgatgacaagggagaaggaacatgtgtacgtgtttgatagcaaacacacaaacaacaatatcatctctgataataatctgatgtgtgatgtgtgtgtattgttgttatgctgcctttgccatcttgtccctctctctcctgttcaactcctaaaagaattgtttggagtcctctcagttcctcgtaaagatcctttcgagattcttctttcctttttattatttattccacgagcctctgacataagtagccttccgcttatttccttctccttgcacttgtcagttccgtgtagagcgtcattttgaggtttacacatttcccaccgacgcctgattgttacattgtcatctacattgctttccgtttaccgttccgccctttttttttaacgctaccacagaaaaggatccggacgttaaggactttgatctgagcggcatctacagctcgaaggcggactggggcgcccagttccgtgcgccgtcgacgctgcaaacgttcgacgagaatggcaggaacggaaatccgaacgggcttacccggaagcaggaaatgatggtgcgcagcgccatcaagtactgggtcgagcggcacaagcacgttgtacggtaggtatggtaatttctaaggtgtggtgtaaagcctccaggttccatgaaaaagggatactttaccacagtaagagtttgttttgctggacttacattctttggagcattgtttggtgttgtgctgaaaccggttgcaatatcgttttgcgaagaaattatgtgtaaagcgtattacaatctcattcctctgttaatctgtaccaattgtgtcagccccgaccgaaagcaggcctaattcgtaccagaaaaaccacaagctgtttgtaagcatcgatacgcccgaagctttcaatccagccaaggcgccacctactattgacgtgactttttgcacgttcacactctccctctcccattctttctataaccaatcgtcgctcagccagcatcgcccggagtgaagtttttatttgaacgatatcacccgtatcgattttccactaaacatgcttaaatcgtttcacaaagctcccccaaaatcccatttcaccaatccaccaatttgaagtccgtcgtcctttgtgtccttgtgtttgtgtgtttgtgtgagctggagacatgggggagtgagtaaccgaacaacctcttgccgctgcttcacgatatcgaacagcaccaagataagcatccctttttccctagccgatgtctccgatatctcgattccgcttccagcgaggcaaagaaaaaggcgaactggctgacctcacccggggcgaggaaaaagcgtagggattacgtcgagcagcacgagttgtgatttcttcttcttctggttccataaatcgctgacggtttccattaccgcctgcggagtgcacacacgtgaagggaaagcgaaaacgtttagattccagcagcaacggcagcaccagaagcagcagcagcgcggcaaattgaatcatcctgacgcgatgagttgtctgggttttcgggtcggtggcttacagcaccacaccatctgctgcagctaatacagctgtaaatttcgttagacatagacttgattttacaatattacacacacacttacacacacagctatagatttgtcgcttggcgtatggctctgtacggcgtgccgtacatgccgcgagccgtgttgctgctggttgcgatacggatcacgtccgattcgattcagcctgcgtgtttttggtgaagatccttatcggtgacccactttcagtgtgtcgagagcgagggtcactatggcgcctgtcagttggaaagctaggctcgattcaaagggccattgtgccagtgttctttttaagatagcgataagcttttgatcgaaatagtaaatcaaacattgtttcttttttcctattccaaactgttgccaacctcattattacgtttttgcagcgggtgtatagtaaattgcatactttaaggcgtgattttcaaatgtagcgttccgtatgcagaaacgccatggattatgcaatttaaacaatgctgcttccttaacattcaaataacggcttattaaggaactttttgtgcaatttgtttttaacagcaaatagttagctcagaacgatcacatttagtatcgcttcaacaaagaactcttttaaacacacaatttgtaatgccattccctcgagaaagtttcttgtcagtcctcctctgcatcacagcaacaaccaaacctgctcatgtttcctgctcgtttcctagctgttttgaacgttatttccgattcctgtgcttgcccgcttttcttacaatcaaccacaatggttcagatttcgctcttattttattgacccactgctttcgtgctgaagcccgtggaaacaatgcgccaagctcagcatccagccatgcatgtaaaatgagccacgcgacagattttagacatcgctttcgctctgcaccggaggtggttttattcttgtttccgattcccacgtccattcgtcctgggtccgtccgccgggcccgaaaccgtaagccgtgcggggaattacgcaatcgaaacgagccagaaaatgagcacgccaaatgcaaagaaaatccccttttgagtggtgctcctgccaccactcatctccccaactggtgggtgaaaaaccttgtgcgccccttctctttccagaaaaaaaacgcctcgctcgcacaaaaacatgctcgcccggtgaagctgcgtatgtcgcagaagctcaaaccaacgccgccagcaagcatcaacaatttctattcaaacacccaacgcagcgcccaaaccgggtgcactgtactcagtagcgaagatgctcagattgtcccgtgcgctgctttcgatgcccgtttcggagcgggaagccatcgcttgccaacgttggcgatgtcttttagccgtggatttgaattttctgaatatcacaggcgggcgcggtttgcctgcaaggttgttgcttcccacacgagcattgctttccgtaccgcggtggggcgagttttcaacgcaaccttctacaagcaacgccacaacgcctgggagcgatatttaacagaaacaagaacatcccgaacttcagcacatgccgtgatttgcctgttggaaaagcttttgtgagcgtgtgagttgaacgagctctattttcccagcgatgggtggcatttgtgtggcatgctatcgtcagcttttcttgaatctttacctctccattcgcctccattagtacacgcgtatggaaaatgggtgcaacggatcagaacggattttccgcgacagacttaataaagggaaagcaacgcgttttttgcatgtgtagtgtttatgagctttatgccgttactttgcaattaaaaatagcaaaaaataacagtttttttttgtaagcggattacaaagaatgtatcagaatattacgtgaaacattcatttcatgctgttaacgctcaaatagaatagttttgtaacacggattgcataccttgccggtatcggttacattttcgcctaacagtatgcaatctgtttagctttgttgtttaatgactgcgttggtagtacaatatttatttacaccgcgtaatttatctcacaaattgcaaaaaaatgtcaatctgtatcgattattcacacaaatcagatcccggaaccagtgtagcccaatgtgctcttattgaattaccacgaacaaatcaacctgatgcccgggtccgttggcaaacagcttgcgccgaagccgctcagtgtttcgtgcactaccgtgctgccattttgctgccctcatcgaacagataaacagaagggcaactcttgtgagcatcgcaatgcccgtctgaagttccgtcgaaaatgggcctaaattcaatttgacgcatttacccgcgaacaattgcgcgaaggctgtcaagtgtgttccacgaactgcgacaacaagcacacacacaaacacaaatgttatcgtttcggcatgtttctcggtacaaagcgtgtggcgctatgtggcatgccgattcccagacagagtgatcgatagtaaatgtagcctatccggtagcattcaatttccttttctatcctcgcaaacaaagcccattctggggaggcgtggtgaagctttcaaaggcattgtgaaacaaatgtcctggttcggagggatgctggggaaagcaaacacggtgccgccatcgctgctaccgtcaatcgatcatgcatgatgtgattaatatttgtgttattcacctgcgtatctatgcgtccgtcgtgtcgttcggatttccggaagtcaaggaaaaagcgactccatttgggattggtttttgcagcgaaaaatcaaaacattcgcacaaaaccgtcctccatttcaaatgcctacacttgtcactgtatatctctctttctctcgttttgccacgttgcagtctcgtttcagcaatcggagatacgtacggtcctgccctgctgctacacatgctgacctccaccatcaagctgacgctgctcgcctaccaggcaacgaaaatcgacggtgtcaacgtgtacggattgaccgtaatcggatatttgtgctacgcgttggctcaggttttcctgttttgcatctttggcaatcggctcatcgaggaggtacgtgcgctcggcgtgttgccgtgggaaagcattctccctgccccatatcgcttcattctcccagatcacacatttgcatcacaaagccagcacacttttgcttcgccgctgccatctcggcttctgaatgttttcacttctcccatacttctcccgtgcagagctcatccgtgatgaaggcggcctattcctgccactggtacgacgggtccgaggaggcaaaaaccttcgtccagatcgtttgtcagcagtgccagaaggcgatgactatttccggagccaagtttttcaccgtttcgctcgatctgtttgcttcggtaagtgtagcctggtggctggcacagaacaggctggcaaaacagggactttggctctagcctgatgggtggtatatgtgtgtctattttttgctaccattctcgcatcccttcctttccaggttcttggagccgttgtcacctacttcatggtgctggtgcagctgaagtaa

SEQ ID NO: 165 - DNA, 1375 bp, Anopheles gambiae
atggacccaccaacagacgagctggtgcgtttcgagtcgtttatccgtgtgccggaaattttcttcgccatgatcggtgtggcacggtacggtgagccgaagcgaacgcttcgggcgtacctaaagcatctgctcttctggtcgtcgtgcatcaataccggcttctgtctcgtgatcgagcatatctacttcgtgaaggcggccggtaactttaccaactttctgcagctgaccgcactggcaccgtgcatgggctttaccgcgctgtcgttcgtgaagatcatgacgatcaagctgaccgagacgaagctgaccgatatgctgcaccggctggatgcgctcttcccgagcacggtcgcactgcagcagcggtacggtgtgtaccagtacaaccgtgaatcgcaggtcgtgatgaaatcgttctcgatcctgtacatgatcctgatctggatgtttaacctgctgccgctggtgtcgatggtggcgggatacgttagcgacggcacgtggcacaagcagctgccgtactttatgtggtactggtacgattggcaccggcccggctacttcgcggtgacgtttctgcaccagaactggggcgggttcgtttcggccgtgttctacctctcgaccgatctgatgttctgtgcgatcgtgctgctgctctgtctgcagtttgacatcgtggcctaccggttgagccacgcgctgcccgatgaccaccaggagctggtcgggtgtgtgcgcatccatcaggcggtgatcgagctgtgcaatgagctggagcacatgttttccccctcgctgctggtcaactttctcagcagctccgtcatcatctgtttggtcgggtttcaggcgacggctgggattacgccggcggatctgttcaagtttgtgctgtttctcgtctcccccctggtgcaggtctttctgctgtgttactatggtaacaagctcatcgttgcggtacgctccaggcagcagcagagttgcgagcagcaatggttgcaatagcgatggttaaatgtgttatttgtttacctttttttctcttaaagagctcgcaaattccctacagcgctttcgaggggaactggatcggggcgtccgtttcttaccagcgatcgctgctgttcgtgatgttacgctccaccaccgtgcagaagctgactgcgctgaaattctccatcgtttctctggcgagctattcgaaggtagggggagagctatttcctgtttgggtatagagcgaaaaaggtcactgaatgattttgctgctttttttatccgctaacagatactaagcacctcgttctcgtactttacgctactgaaagctatgtacgaacctaatgagaagaaaatgaagtga

SEQ ID NO: 166 - DNA, 1660 bp, Anopheles gambiae
  modified_base (1062): A, C, G, or T
atgtttctaccatcgttgcgtatgattttgttcatttttcgaatgttttacgcgtggccggacgagcatttggagaaaagtgctctctggtggtaccgtgcaaagggtgtgctgtttcgtgtgtttttcatatatctttcagcagccacacagctagcttacaacttcactgtgactagtcgtgaggtgagatggccagatgtactcaattttggtaagaaatctatttaaattgagtggtctttccatacaggaactgtttgctggaatgtttgtgctgctcactcagcttgtgatgatactgaagatggagtttttctacaaaaatgtgttcaaaattcaacagctcatccgtagactgaatggcaagctctaccagtcgagaaatgcggaggaagacatgtaagtagctgaatattgtttgatgtctgaatcattagctattccctcttatataatctattggcagtccgctggcgagtgcgcgtaagaagtcaactatattctgggtcttgtacttcatgttttccgatgggctggttacggagtggttagtgatatcgttgttgctcactactttgatagtaccggtgtggcccagagtagatcataccaccccgtattgggtagttttaatggttatcttgtatcagtacatggcaatcgttctcaacgcttcgtttaacatatcatgggactcactggtggcagcactgttggcgttaactaacgcccatcttcatcgactgcaaatacagctattgaaggtggtgtactggtggaaacggttgagttgattcagcactcatctgtatgtggtttgtaggtaggacatcagaaccgtaatctgcaggtggatgctaataagcgtatgattacggtctctccaatcgatgatgatgctcggagcgtcccaccgaaatcagatgcagatgtagtttacaatgaactactacaatgtattatctttcatcaggaagtaactgggtagatagataaaggaatgaagccctgcagttgttctacaactgttagatgcactctctattttcgcagatttcnttcgcgaagtgctgaccctgttcagtggaccgatgctttctcagctgtactgttccgtgttcatcctgtgtattaccgagtttcgtttgctcacagacgtgaacacaatggccgacacgatgcaggcggtaatgtacttggtgtgccttgtcatacaagtggtgcaatactgttactttggcaatgaaattaactatatggtaagtagttgaaaactgcagttagaactgtatttgtaaccgttattgcaattcaaggctcaaaaggtacatcaagcgaccgcctttgtgaactacccggatatgaacatcaaaactagaaagcttcttatagcttttcaacaaatgtaagcttttagaggcgtattctaaatgtgatacacttaatacacttttcacaattccagaaccgctcgaggaataaagtgcagtgcgaagtacatttttacaatcgaactgagcatgcagacctttgtgacggtaaggcaaaatggtagacacaacattttaggaactcgttattaataatttttttttccgcaaagatcatcaaaacatcctactcgtatttggcagttttgagatcgatgacggattag

SEQ ID NO: 167 - DNA, 1616 bp, Anopheles gambiae
  modified_base (218): A, C, G, or T
  modified_base (322): A, C, G, or T
atggaggtcctcaactgtccgctactgtcggtgaatgtgcgcgtgtggcgcttctggtcattcgtgctggtgcacaactggcgacggtacatcagcatcatcccggtgacggcgctgaacgtgttcatgtttgccgacctgtaccgggcctggggcaacatcgaggaggtcattattaatgcttattttgcggtgctctatttcaacgcggtggtaangtgcattccgggtccgggcagaactctggggaaactccgatcaggggttgattaatttgcgggtttcggttgcggtttcacatgcagctgcgcacgctgatacntggtgtacaatcgggacaagtacgagtcattcctggccggtgcggccagcgtgtacgaggaaatacgagtaagtgaaagttaccttttccgcaaacggatcaaagcgggcgatagggaagaaattcgaactgtattgcataccttcgggggcttacacatgctcgagcagcaatcgaagagtgagcgatacatttcgcctgcagctatgcaattgattgtagtattttagcaagccgtttgcctaaaaatttctttttaaggctatcaacgatgacgtcatcacgaaactcgtctcaacgtacactaaaagggctcgcttcctgtccatctccaacctggcgctcggtgcgttcatcagtgggtgtttcgttgtgtacccactgtttaccgggcagcggggcctaccgtacgggatgttcataccgggcgtgaacaatttcgactcaccgcagtacgaaatcttctacatcacccagctggtgctgacgttccccgggtgctgtatgtacattccgtacacgagcttcttcgcctcgagcaccctgttcgggctggtgcagatcaaaacgttgcagcatcagctgaaaaccttccgcagctcggaaatgctcaacgaaagcacggtggtgctcaaccgaaagcttcagaagctgatcgaagatcacaagcgaatcattcggtaggttgtgttgtgttttaagagggatagaaacgtatcataagtaatcagtttttgtgtgttttaatttcagctatgtgcaagatcttaacgatctggtgacctacatctgcctgatagagttcctgtcgttcggattaatgttgtgcgcgctgctgttcttacttaatattgtaattttctacttccgaccaacgagcaaagcagcattcactgtttgttttcccctttcagatcagtgtgatggctcagatcgttatcgttggagcgtacattttcatgatcctcacacaaatatttgccttctactggcactcgaacgaggtgcgggaggaaagcatggccatcgcacaggcctcgtacagcggaccgtggctgaatgtggatgacactattaaaaagaagcttctcatgatgacgatccgtgcccagcgtccactagaggtaattacaacccggagaagtatcaatgcttcacaggctacacttgtctatttattcctatcgaacagatcacagttggtaacgtgtatccgatgacgctggaaatgtttcaatcactgctgaatgcgtcctactcgtactttacgcttctgagaagagtttacaattaa

SEQ ID NO: 168 - DNA, 1508 bp, Anopheles gambiae
  modified_base (1136): A, C, G, or T
atggagctgaaggaagaatggatccttccggacgtggtgtacgcaaatccgctgctaaagcgtaccctgctcggcctaaggtactacggcatactgctcggtcagtcacaaagctacaagaaagtgcactgcttccggggcatggtgtttacgctgtcgatggtgctgtttaactgcacgcagtacatcgatctgtggcaggtatggggctccgtttcggacatgacggcgaacgcggccaccacgctactgttcagcacgaccatctttcgcatcatcttcttctactttcatcgggcgcgtgagtagaaaattgtactttttttatgtatttctgtgtttaaaaaatctcttttttgtcgttacaggatttaccagcatcattaaagccgctcacgacggtatcgagcggatcttgaaggacggttggaccgatgagcagagcattgtgggcagcaatgtgcgctatctgaagcggcttgccgttgtcttctggagctgcgccctagtgacggccaacatgatgtgcgtgtattctttggtgcaatatttaacgtacgaagaaggaccgcccgatggcactgggacgagtgctgcgaacatcacgcgcaaagggcaaccgattccaccgacgccaattctacgctcctggtatccaacggccgatgggaaggataagcactttctcgagatttacctcatccagctgtacatcatgtatgtcggccagctgatcgtcccgtcctggcacatgtttatggtcacgctgatgatctacggccgcaccgagtgtagtgtgctgaaccatcggctctgctttctggaacgctaccacacggctggaaaggacgatcctaccgccccggtaaacaacgctgaacgccgatcgcttatgatcgattgcatcaaacggcaggcaagcttggtatcgttcaccagggagctggagcagctaacgcgtgccgccgtgttccttgactttgtcgtgttttccgtcctgctctgtgcgctactgttcgaagcatcgatgacgccgtccggggtgcaggtgtttatcgacgtctgctacattaccacgatgacgacgattctgttcctttactattggcacgcgaacgagatacatgcgtgcgtgnagtatttcggttttttttttgcatggtcgagtaactatggctttttggctttaatttgccccaccttttttgttttcattgcaggccgaccggctttcaatgtcggcgtacaaaagtgactggtatcggtacgatcggggcacgaaccggatgctacagatctttatcctgtacagcaatcggccgcttaaaatgcacgcattctttatctcgatgtcgctggacacgtttttagcggtaagtggaatttggcagctcttttttcatactatttaactctaaactaacctttgctaactacactccatccagattctgcgcgcgtcgtacagttatttcacaattttgaaacaattaccgactaacttttaa

SEQ ID NO: 169 - DNA, 1402 bp, Anopheles gambiae
atggaaaagctacgtccagaagatccgaaggcagttatgccttacgcaaagcgacttcttcagctgtctggtttcagacaggatacggaacagcttggaacaagaatttacttgaatcttttcatcttcgttgcagcaattttgataccgaaagtgtgctttccctacccggatactgaagccatggttcgaggcttaagtgagctgatctttttcaccaacatatttgttggccttttctgcttcattgctcagcatcgcccctacagagaactactaaatgcgatcgaatccttcgtaaatattggtaagtgttcgctaagcggattttccaataccattattgcaattgctgttgttctcttcatcaaaagtgtaccgtacatcatcacaacaacccgaatcactatcagaacgaaccttgatcaaactaaacgttaagataaatcaaatttccgttgtctactgctattacgtagcagtggcagccttcacgtactggattgcaccatgcttgataacatacctttcgattcacaaagaacaagacatcgcaggaaatggaacgatgaatgcgatccaatactacccgaacctcgaggaatcgttttactggcttgacaatcgtacttctgtgaggggttatgccgtgttgagtgtagtggcattcataacatttatatttgccgtatatagtcaaactacaaagctactaacgatcctgtccacgatcaagtactgcagcacactgcttcagctcgtcaacatcgctattgaaggattgagcagtataagtccagaaaacattgatctagagctcaaaaaactcatccaaatgcatcagctggcaattcggtatgctgcttctaccagtcaattgtttcacgagaactaatcaccatcgctcgtccttatcattcccttagctgtgtcgcactgctcaatcaaacgttaagctatgtattcgctcttcagctggtgttgtgcatgttgacctggtgcttcacgcttctatacgtcctagtcgtcagactcgatgtgacatcgatgatgagcttgctgataatgatcaatttgacgcccgaaatgtttgggtactgctttttctgcagcgatcttactaccaccggtacaaccattagccggcagatgtacgagttccaatgggaacgacatcgtcctgcgatacagaaaacggttgcaatggttattgcccgtggccaagcacggctacggattacagcgtggggcattattccaatcgatctcgaattgtttgctaaggttagtagtggtagcaaggagcaatacagatcatgtagtcatcctttaaaaatatcctgttttgtaggttgtcaaggcatcttacaccgttcttctcgtgctaaaggatttcatctag

SEQ ID NO: 170 - DNA, 1442 bp, Anopheles gambiae
  modified_base (1141): A, C, G, or T
  modified_base (1148): A, C, G, or T
  modified_base (1157): A, C, G, or T
  modified_base (1242): A, C, G, or T
  modified_base (1282): A, C, G, or T
  modified_base (1308): A, C, G, or T
atgaatttcctccgacaggagcaaccggctggcatgcctcatatctccatcaaactgcttcaactgtttggcgttaccggctctccagaggaacgctttcgtatcctgccggttatgctgacctactttttcttcatagtagtgcccaagtgcttcttcggatatcccgaccttgagataacaatcattggcactgctgagctgattttccaatccaatactttttgtggaatgttttggttgtttctgaacagacacaagctagcacagttcattacacaagtacgaactttttctctaacgggtaagtttatggatgtaaggataaaactgtaatataattgagtctccttgacatcacacagttttccgagagtcacctccagcggtggtccagcatttaacgacccagcacgactttatccacaagataacccgaatctattgcatcgtagtgatgtttgcagcccacttctacgtgctaactccattgctttcaacattctacgcgttctacggtacggtacggaacgataacgtaaccgtgcactacacgctgcaaatggaggaaaacttctacggactacagactcgcacgacgacttcgcactacctgatcttcggcatgttcatgacgcccaccatttatctctgtgccttcaccggtacggtaaagatcctgagcatctgtaacattaccatgtattgtaccctttactttcaactggtacaactgaagctacgaaccgcaacggaggacaacacgttcaaccgtcaggaggtgaagtcgattgtcgtaatgcatcaggatgcgcttaactgtgcaagcctggtagaatctatcacgtcactagtgctattacagcaactggtcctatgcgtaatgatctggagctcaatgctgctttacttcaccgtatcggtacctatgaaacccatcgtaggcgtgtgtcaacttttatcaagactgactctaagctttcgattacagggtttcgatttgaactttattaaccttctcgtccttttcgcttttgatacaacagaaaccattgcttactgctattttggagagcagctatcgaacgaggtaagtgatccatcgtcatgtcactaagaaagagacgttcaagattttttngaacggnttttttttnctgttcagagtgctcgtgtggcacataccgtttacgaaagtggatgggaaactcaaactcccgacatacagaaagatcttcagcntaattatcgcgcgcgcacaaaggccggttggcatcactgnctggcaagttttgctacatgaacatnggaacaacttggcattgtatgttgtataggaacaaaagatacctcatctggatcagtcacgatgacctcgcttttatttccagatagtgaaaactacctactctatctacatcatattaagagatcagttttaa

SEQ ID NO: 171 - DNA, 1545 bp, Anopheles gambiae
atgcttttccaagagttgccgaacgatcgtgccgtcctgccgctgcttctgtacattcaggagcggcttgggttttggggagatcgtaccacccgggtacgctatccggtcgctttcgtggcgttctggattaccgtggccataccgaaacttgcgacagactacagtgatgtggaattgttcatctgctcgatggcggagcttgctttcgtgggaaacgttttctgcggtgggatggcgctctggtcggtgtacaattccttcagacaattcatcgagcaagtcatcaggttgacgaaatattgtaagattgccgcatttagggcattatgtgtaggcccgtttttctgtgaagttggatacattttatttctccagtgtatagagaccatcatccgctacagactgtacgggagcaactgttgcagtttaaccatcgaatccatcgctacaccaacagatactgtttctcgatgatgattttaattgtattctaccttgtggcaccagtaataaccagcttcggggtgtactttcaatccgtatggcaatctcaccatgatacaaatgacactatccgtatctgggaaatttctcaagtggcaccacatcggcaattttcccttcacatggagcaagatttctacggactccagcatcggaccaacattcttcactacacactctacatcgcagtcatagtgccgatgatgttcgtaacggcctgtaccgtgcatatgaaggtgctaactattgcatcttctgttcggtacgctgaaatgctgctccacgttgtgatgctcaaggttgacaacttgcaccgaatacccaaccagaagtccatccgtgaagaactgcatgacataatccatgtacatcaacggacgctcaactgcatcaccctgctcgtgcaggctctacggcccatcctaatggttcagctcgtgttttgtgtctttatctggtgtttgatgatgcttttctttaccattgcagtaagtagcacagtgcgctggacaaacgttataagcacacgttaacttatttgattgtctgcccttttccgccaaggataagttcagtgttgcgtttttcaatcttgcgatactgttcgtcgtcatcacgatcgaaacgtttagcgcgtgttattttggaacgcgcctctctacccaggtaacgttgtccgtcacgttacgtggttttgtctattttaagcaacgctaaccacaaactcataaacgtccccgggagggtcccgtaggcagttgagctctcgaaaagcgtgtacggttgcggatggccagcgatggaccgtgacatccagcagggactgcgcatggtgctgcatcgcacgcaatcgccggtcggcatacaggcgggcaagttttgtttcgtcgatgtggagctgtttcagaatgtatgtagcgattgtctccattaaccaactatatcaagctaaaaggttttttggacgggattttttaccccttgcagatggttaataagtcctactcgttctttattgtgctgaaggatgccttctag

SEQ ID NO: 172 - DNA, 1434 bp, Anopheles gambiae
  modified_base (267): A, C, G, or T
  modified_base (421): A, C, G, or T
  modified_base (547): A, C, G, or T
atgaacttcctaagacaggagcaaccggctggcatgcctcatatctccatcaagctgctccgggtatttggcgttaccaatcattcagaggaacgctttcgtatcgtgccggttatgctggcctactttttcttcatagtagtgcccaagtgcttcttcggatatcccgaccttgagataatgatcattggcaccgctgagctgattttccaaaccaactccttttgcggaatgtttctgttgtttctgaacagacgcaaactggcntgagttcattcaacatgctagaagtttctcccaaacgggtaagttttaacaaactagaaaaacaagcaaaattaacccggcacattttgttacagttatctgtgcgtcacctcccgcagtggtccggcatttgacgacccagcacgacatgatnccacaagataaccagaatcttctgcatcgtagtgatgtttgcagctcatttttacgcattagctccttttctttctacactttacacgttttacggtacggtacggaacaaaaacgcaaccatgcnactacacgctgcaaatggaggaaaacttctacggactacagactcgcacctcggctacgcactacctgatcttcggtatcgtcatgacgcctaccgcgtatctctgtgccttcaccggcacggtgaagactctaaccatctgtaatattactacctactgtaccctttactttcaactggtacaactgaagctacgaaccgtcacgcaagacaacacgttccgccaggagttgaagtcggtgatcaagatgcatcaggatgcacttaactgtgcaagtctggtagaatctatcacgtcactagcgctattacagcaactgcttctatgcgtattgatctggagctcaatgctgctttacttcaccgtatcggtatgtggcaagtaaccttattgaatgtatcatcaaacttgacactgagctttcaatctgcagggattcaatgtgaactttatgaaccttttcgtactgttcgtgttcgacacaacggaaacctttgcctactgttatcttggggaaaagctatcgtacgaggtaagttgttcttttgatgccagtgtgatgaagattcttaagttcttcctctctctctctctctgtttttctgtttagagtgctcgtgtagcacataccatttacgaaagtgggtgggaaactcaaaccaccgacatacagaaagatcttcagctaattcttgtccgtgctcaaagtccagttggcatcactgctggaaagttttactacatgaacatggaacagtttggcattgtaagttgtggtgatatctcttcgtaagctgacgccctgacgatcgttttctctcatctttatttccagatagtaaaaactacctactcgttctttgtgatattgcgggatcagatttaa

SEQ ID NO: 173 - DNA, 1440 bp, Anopheles gambiae
atgaggttcttcttaatcgaaaaaccgcccggtgtgccgcacattgcactgaagctcctaagactggttggagtttcacagacgcaaagcgaaagatatcgatacgtgccgatgtttgtgctatttttacttacaatagctataccgaagattgcgtttggatatcccaactttgagacatctatcatcggtttggctgagctgttctttcaaacgaatcgtttcgttggggtattattgttagtgctctatagtgattcgatttttgagcttgtgcgacagtcagaattcttcgcgaagaaaggtaagtcgattaccattttttgttttaggacttattactaatagtatgccgaatttaaagttcttagcgaaacgtctccagttgctgaatatcttaccaagatggacacccaagtcaccaaaatcactaaactgtaccttaccgcccttctggtaccggctaacttctacagctactccccaattgttgcgaccctttggaagtattacaacacatacgaaaacgacaccgtcccggagtttaccctacacatggaggaaagcttctacagactaaatgttcgggaaaagctggaccactacctgatctttggtgccatcatggtgccaatttcgtttctttgtgctctcgtcggaacagccaaacttgtgtcgattctgagcctcatcaagtactgcaccatctacttccagctggttaaggttaaactagaagaggttggccgttctcaaaattatgctagtgatataagatccgctattcaaatgcatcaaagtgcgctcagctgtgccgatgtgctacatgatatcaccgctcccatcatgctactgcagctagtgctttgtataatggtgtggagttcaatgctgctgtacttcaccgtggcggtaaaatgcaacagattactacttatctcacagatatttcaatctccactcacttcatctctcacatccagggatttaatacacagtttattagtctgtttatattggtcatgttcgacacaaccgaaacgtttggatattgctacttgggtaatcaactttctgacgaggtgatttagcgggtgatccaatcggcaaacaggcttcgacattaattcattatttgctttcagagcgctcgtgtcgccagtgttgtgtacgactgcagatgggaaggtatgcctccagctttacgcaaagacctgcagctcataatgctacgtgctcaacggtctgttggtattactgctggcaagttttgttttatgaacatggaacagtttggtgaggtaagtgtcgcaatcgtctgcgaaaatatggcagaaaatcgattaattatgacacaaaatccatttgtttaacgtttccctattacaggtcgtcaagacaacgtattcatttttcgttgtcttgagggatcaattttaa

SEQ ID NO: 174 - DNA, 1433 bp, Anopheles gambiae
  modified_base (54): A, C, G, or T
  modified_base (89): A, C, G, or T
atgaacttcctccgacaggagcacccggctggcatgcctcatatttccatcaangctgctccgagtgtttggcgttaccggcggtcccngacgtacgctttcgcatcctgccggttatgttgacctacgttttctgcatagtagtgcccaagtgcttctacggataccccaatcaggagatagccatcattggcatagccgagctgtttttcttaaccaactcgttttgtggaatgtttctgttgtttctgaacagacataagctagctgaattcattagacatgtacgaactttctctctaacgggtaagtttatggataacaaaaagaaatagtaatataattgactttttgataattgatacagttctccaagagtcacctccagcggtggtccagcatttgacgacccagcacgacttcatccacaagataacccgaatgtattgcatcgtagtgatgtttgcagcccatttctacgtgctaactccctttctctcaaccctctacgcgttctacggtacggtacggaacgaaaacgcaacaatgcactttgcactgcaaattgaggaaaacttctatggacttcagactcgcacgacgacttcgcactacttgctcttcggcatgatcatgacgcctaccgtctatctctgcgcattcaccggcacggtgaaaactgtgaccatctgtgacactaccatccattgtatcctttactttcaactggcacaactaaagctacggatcgtgacgcaggacaacacgttccgccaggagttgaagacggtgatcaagatgcatcaggatgcgcttaactgtgcaagcctgcttgaatctatcacgtcactggtgctgttgctccagctgattctatgcgtattgatctggagctcaatgctcctttacttcaccgtgtcagtaagtgatgatctcatctaatacaaaccctttaaatctgacaattttgagttttcgattgcagggattcgatctaaattttattagcctgattatcttgttcgtgttcgatacaacggaaacctttgcctactgttatcttggggaactgttatcgtacgaggtaagtttttttatgccaatatgatggagattcttaagttcttcctctttctatcgatcttgtgattctgttcagagtgctcgtatagcacacatcgtttacaaaaacggctgggagcgacaacacgcgtacgtacaaaaagatcttcaggtaattatcgcgcgcgcacaaaagactgttggcattaccgctggcaaattttgctacatgaacatggcacaacttggcattgtaaattgtggtgatatctcttctaaaagctgacgcactgaacgttttctctaatgttcatttgcagatagtgaaaactacctactctttctttgttatattgagggatcagatttaa

SEQ ID NO: 175 - DNA, 1506 bp, Anopheles gambiae
atgacttcgttcaagccgactgacgacacggacgtaatgccgctagtgttacgcctgctgcgagtcatcggagtctgggacgtgccacaatatcgctacaggtacgccgcggtttttctgtcctactgtttcggcattctcatccccaaactgtgtttcggctatccaacgctggaagcatcgatccgcggttacaccgagctaatactcgaaacgaacgtatttgccgggatgctgcagctttatctgtgctataatcacttcgtaccgttggtcgacgaattgcgagcattcgctgctattggtaagagtagcgaagacgataccgtgtgactgctattcgcaggttgttctttgtgtgatgtttcatatcctctccaatcctcatcgtatagtgttccaagacaatcaacccatgttacttaggaccaacctcacggatctgaaccttcgcatccacaagtacaccctgtgctactgtctctacatgtgctgcgtctgtacggtgtactgtgttgcaccgctgggcagtaacattgccggctacaccgcagcgatggcagatacggcgagcaacagcagcaccacgttcgcctttaccctctacctcgagcagggattctactggctggacaatcgtacctcgctgcttgggtactgcgtctgtaccgtgttcatgttgccgctcatgtacctttgtgcctacaccgcaacggtgaaggttgtggctgtttttaacatgatcaagtactgccaaacggtgctgcgaattgtagtgttaaagcttcgtctgctgaagacactgccggacgtacgccagcgatccgacgggatgtctgaggtatgggtacttcatcagagagcgcttcgctgtgccgaactgctggagctggtacttcagccactcctgctcatgcagtttgtgctgtgcatcttgatctggtgtatgatgctgctttacttcactgtttctgtgagttacaatcatgctaatgagtttcaaaccaaaaaacgcccaacgaacgtaatatatctcccaatttttagggcctcaatgtaaagtttatcaacatgtttctgctatttctgttcgtgtcgatagaaacgtttggctattgctatctcggaacgcagctctcgcaggaggtatgtaccgtagcattgaaatttactctcttgcaactctgttttgcgctccatcctcacagagcatcaacgtcgggcaggcactgtacgcttccggctggtacgagtacgatgtgcaaatgcgtaagcacatcagcttcatgattatgcgatcgcagcgccgggtagggctaacggcggccaagttttgcttcgtcgatatggagcagttcggagcggtgtgtgccatcagtttatggattagagggggagcgcgctggtactttctattaaattattctgactgtctttttattctccttcactcagatgctcaacatgtcgtattccttcttcgtggtacttaaggatgcattttaa

SEQ ID NO: 176 - DNA, 1416 bp, Anopheles gambiae
  modified_base (630): A, C, G, or T
atgttgagattaagcccagaagacccgaaagcagttatgcctgtcgtgaagcgtttgttgaagttgtccggattaacccaagagacgacgcgctttggcgcaatcaacttcctgaatttgttcatctacattgctgccgttttggtaccgaaggtgtgctttccctatcccaacaccgaagccatgatacgaggcttaagtgagctgatctttttcaccaacgtttacgtgggcttcttctgcttcatcagtcagcatcgccactagagagatctgctgaacgcgattgactccttcgttgatgtgggtgagttgtgcgcttggcaagtatggctttagcaatctggtacttattctactacgccgtatcctcagtgtaccccactgcggctcatccgtcagattccccgtcggagcaaattctgatcaagtttaatgtaaagatacaaaagctatcggtagtgttctgctggtacatagcggtgacagccaccttctactggctggcaccatgtctgatgacgtaccgctctatatacatggcatcggttagtgttgaaaatggatcggtccaatcgatccaatactaccctaacctggaggaatcgttttactggcttgataatcgtnagttctgtgtacggttatgccacatttagcatagtagcgttgctagtgtttactgtcgcttcgtacaacaatgccacaaagctgctaaccatcttaaccacgatcaagtattgcaacacgcttcttcagctggtcattatagaggttgataacttgaaccacgccacctcaaatgccatcgatcgagagttgaaacaagtgattcaattgcatcagcgggctgttcggtaatgcggtgcttctaccaatcataggttcaggtacactacaaattatttttcctattcaactttctctcagctgtgtcgcgctactcaatcaaacgctaagctttgtaatgaccgtacagctcgctctttgcatcctgacctggtgcttcacgcttctctacatcctcaccgttgggctggatgtgacgggaatgaacgggttgctgattatgttcaacatgacgctcgaaatgtttggctactgtttcttctgcaccgaactagccaccaccggtacgctcattgcctgccaatcgtacgagttccgatgggaggaacatgatccgaaaattcaaaaaatgatttcaaccattgtggcccgcagtcagctaccgctacgcattacggcgtgcggtttcatcacggttaacgtggagctgtttgccaaggtgagaatgaaactgtgtttgcggactaatagtcgatcgagaatgtattctcctcctggaaacatgttgtctttcaggtcgttaagacaacttactcgggtttcattgtgctgaaggatttcatataa

SEQ ID NO: 177 - DNA, 1479 bp, Anopheles gambiae
atggcgtttctgacgactgtacaagctagaatatcttttcaaaatacacactcctgcggccagtgccgttgtggctgtgcggcaataacgatcatgttgaggttgagcccagaagatccaaaggcagttatgccgttcgcaaagcgtcttcttcggctgtctggttttagacaggaaacggaacagcttgaaaagcaaatattcttcaatctgttcgtctacgttgcagcgctattgattcctaaagtgtgctctccgtaccccgactccgaagccattatacgaggcttaagtgaactgatctttttcactaacgtttacgttggctactactgcttcgtcgttcagcatcgccactacagagatctgctcgatgaaattcagtccttcgtaaatgtcggtaagtttttgcattccaagcttttcccgaccgctacattatattgttctccttctccgaatcaacagtatacccaacatctcaacaacccgaatccccatcagaacgaaccttgatcaaactaaacgttaagataaataaaatttcggttctctactgctggtacttagcagcggcaggcttgatttattggagcactccatgcctgatgacgtaccactcagtactcaaagcaaaggcggaatatggaccgaaccacccaatccgattctaccccaacctggagggatcgttttacgggcttgacaaccgtacttcggtgtatggctatgccgcgtttagcatagtagcattactagtctttgcttttgcttcgtacaacaatgccacaaagctgctaacgatcctgtccacgatcaagtactgcagcactcttctacagcttgtaggtgttgaggttgataacttgaaccacacctcttcagaagccatcggtcgagagctgaaaaaggtcatccaactgcatcagcttgctctgcggtaagctattacctgcaacaagaactctgaaacctatcacatctgatacaaccattttgtcttaccctttcaggtgtgttgctctgctcaaccaaacgctaagctttgtaatggctctgcagctagccctatgcattctgacctggtgcttcacgcttctctacatcctgatcgtcggattcaatgcaatcgcgacgaatggtttgctgattatgatcaatatgacgcttgaaatgtttggctactgctttttctgcaccgagcttgacaccacgggcaagatcgttagcaggcaaatgtacgagttccgatgggaacagcatcgtcccacggtacagaaaatggtggcgatgattattgcccgcagccaaactccgcttcaaattacggcgtgcggctttatcccgatcaatctcgaattgttcactaaggtgagtaacattatgacgaccctgagctgtttcatttcgattttttttatattgcaggtggttaagcactcctacacggttcttgccgtactgaaagatctgatatag

SEQ ID NO: 178 - DNA, 1456 bp, Anopheles gambiae
atgttctcgttgggcaaatctcaccagtacctcgagctgagctacaatcgcatctacgaagtgtttcattggtttctgaaaattagcctgctgcgcatctttgacgatgactttctggtggcccccgtaccgaccactttgtttcagtttcacgaaacggagctggtcgtttcgctcggtgtcattctgctgcatgcgtactgctaccgcaacgatctcgacacaatcatactgagcgtgtcggcgtttgtgtccgcgttcgagctgatgctcaaaatcaacggcatggtctatcggcgcaaacagatcgcggcgatgctccgtaccgtgctgagcgatcgcagctctctgaacggtccgatcgaggctgtcatctgcgggaagtatcagcgcttagcaaggtaagggatgtgtaattttgcagctaaattttcgacattttcattttcccacaaaccacagaaagctcttgctggtcacaatcctgtcctacctgacgacgggcgcaatgctgctaatctatcccgtggtgtcgggtgggctcgccgaccgaacacttccactgggctattcgataccgtttgctgactaccgcacccatccctggtatctgatcaactatctgctgcagatcgtgcaggtgcagtgggtggcgctggtgtttgtggggctggatggtcccttctacctgtttgtgtgctactcggcctcccagctggagatattgattgtgtatctgcgccaaattggcgaaaggtaagcgttacgcctaaaggtatgcaatcgccggacattcttcgcttattgtgcgtatctttcagtcccgataacgtgcaggagcagcggcgattgatgcggaaggtgtttgaaatccacaccggactttctcagtgagtttttttgtgtctcgttttgtctcgtgaagcatttacactatgtctgctatttgttggtgtagattcgttgctcgatgttccagcatctaccgggaggtgtacctgatgcaggtgctctgctcgatcgtccacatctgtgtgtcgttgtttcacattcagatcaagtttaaaaatggttcatacggcatgctgctcacaaatgtgaacaaaatatggctattctgctactgtggtgagttggtcgtcagtaaggcggctgagttcagtaccggcgtgtacgcgaatcagtggtaccggctgtggaatcgacgggatctgcaggacattctgtttatgctgcggaacgcccagcgcaactatggcttcagcatcggcgggtttggctttctgtcctttgccacctttacagcggtaagggttcgttgggcgctcccacgatccgcttcctttatggtcgctttacacgaaccatcaccaccgtttcgctcgttgttttttgttggcaggttatgaaaactgcctacagctgtaacgccttcctgcaccgggtgatgaactga

SEQ ID NO: 179 - DNA, 1422 bp, Anopheles gambiae
  modified_base (754): A, C, G, or T
atgcggtggcgaaaggatgaaaccgggctacacacgccgcaatgcacggttgatcttcctggtgacggatctcattctgtatctgttcgtaaacctctactcgatcgcgatcgtttggggatcgctgatggatgttgtgttttgctttgttacgctgggaatcgctatacaggtgagttgatgaagttctactttgaacactccataactcatcatggcccctctgcacagggtctagcaaagattgaagccttcacctgtccggagctgaacgatctgcatctgtacaatgtggcacggttcaaagcgccccctcgcttcccggaagttgacgaggcactcttccacaccgccaccatgtgtatggtgtttatacgcatattcgccgtagcgttctcgatcgtcgccattgccatctactcgtacgccatcctgatgcctttgatcgagcacgaactatcgctcgcatttgggttctatctgccgtttgtcgattatcgcacgcctgtcggatttgccatcaactgggtgtatcagtttgtgcaggtgctggaaggatgtattgggctgatggcgtgcgactcctgtctgctggtactgatcatgaatgctaccggtcagatggacgttatcattgtctatctgaagcagctgacgctactgatagataataatcacactggacaacatgatgaggaaattgcagatattataaaagaaattgtgctcaagcatttagagcacaccaagtaangtggttgttgggcattgggtgcttttttccagctgaaatttgcaactcgaaaccactccaggtacatgacggacatggataagcttctcaaaaagcagttcttcatcaactttggatgcatgattttcgagctcgttgcatcactagcgatcgttgttagggtaattaatcataggttaagatcttaaagtgctttaaataactctttttctcaaccttccactgaatctcaggttccttggtatccaggtatggcgatctgtctgatttgcaccaatcaactctttatcaactgtgcattgggaacattcctatcatcgaaggtaagaagtacttgttggctatttcgctacattgtatgtcctcgtttttttctaatctcattcttccagaatgaaaaactggtggaggagatctacaacgtaaactggtacggactgacgacgaagcaccagaagacacttcagcaaatattgctcacctctcaacatcctgtggtactctccgatgggttctcacctatcgatttgttcaactttgtagaggtaaaatcattaaattttgtttcgtttggggtcgtttttatatttttaactggttttcctcgccttttttagatatacaagaagatttattcctatttaatggttttgcagaaagtatcttaa

SEQ ID NO: 180 - DNA, 1428 bp, Anopheles gambiae
atggatttaactgcgggaattgagtcctttaacaaatcaatgggagtgtcttttttcaagcgcaagcattctttcgtcaacttcttctttatcttcggtatcagcaacttggtgctctacgttgtgagtgtgttaatttcgtcgtataaatcgcgccacgatattattaagctaatctactgcattgctacatttggattttgctgtcaggtaaaataaaagcagtacatttctacagttttgctgattaaaacactgtaatctctgtttgcaggccattatgaaaatatacagctttattataactcgtcagcgagtcgttgatttgtacgagatcaatcatcgttactatcaacatatgatgggtcaaagtattgcagtcaagcgtgtgctgtgtgataatgccagtcttatttacatcgtgattaaagtgactgttctagcttatcttctattagtgataacagcaatgagcattcctggtttgtcatcgatatttctggcagatcgcatactgccgtttggatttgtcatgcccttcatagatgcaaacacattggctgggtactatgccaactatggcattcagcttataatggccatttactattggatcatcacggttgggtctgacatcactaccatctacaatctactgactgcgtacggccaactggacgtcctgatgactatcacagaggaactgaatgaacagcttgaacgtaatgagagcctcgatacgatccaagataaaatagttgagatcatacggcagtatcagcaccatcgaacttacttaaagcaacttgtagactttttgaatccataccactttgtaacgctcatctcaacggttccaactatggttatctcggtgctgggattggttttggtaagtatcattttgtttaatatttgtcttctgtttactattcttggtaaaacatctttactttctgggtccatttacagctggattggtatccgggggctgctattgtgtttcttggatcggttcaaatattttacatttgctttcttggaaccagcctcgaacttaagggtggagttgtaaaacgagacaacagtcttgaatctttgactttatctgtagtggtttcttgcagaccaatgctctcacgttgaaaattggtgccatccattgggataaactctctggtcgagacatgaagttcatgaaaatggtgctaatgatgtcgcaaaaaccaaaaatgctgatggcagccacgttacccttaaacattacggcgtttttgcaggtattgtaaatgataataaatttttacattatttattgtcattcagtatacaataaaatatattaatattttcgatgtataaatatattttcagattcataagtttatatattcattgattatgatgctggaaaacactaaaggttga

SEQ ID NO: 181 - DNA, 1258 bp, Anopheles gambiae
atggaacaagaaatcaaccaaataatctcctttctgcgacgccctttgaaatggctcggttttgatgtgatcgatccaaactggaaggtgacgccgttgacaatgttcacgattgtcatgtttgccttgcaacactacaccacctacttgtatttatctacccatctggatatgttcgatatgttcaccgaatgcttttccacatcggccgtcgcgctggagatagcgatccggatgggcctgctggtacaccaacgcgagctgcggaacgaaacgatcgaaatcatacgccaacaacagtaagtgttcaggaagtaatctgtggtgaagtgatgggaatactctacttcgcttttcttatttttattttccattggttttgagttatcaaaacgtttggaaacagtgctgcaatcaggaaggttacggcacggttccacaagctgatttccgtgacactgcacgcacttgccgcatgctacatgtcgacgatgatgttcgagctgatcccgatcgtgtctcccaatccgagaaagagcaatcttccacttccgatgtacctgccgtacatgccgcatgatgtgacgccctactggcacctgaactataccttcatcacggtcatgaacttaatgtgtatactgtttctggtcggcattgacgggctgctggtgctgtccattctggctgccgtgcaccaaatcaagctgctaaagataaccatccaggagctggacatcggtgcggagcaggcggagttacaccgggagcttgtacgcattattcagatacatcaacgcatccagcagttcatccaccaactagaacaaacgtactacatcgatctgttggtcgactttggtcttggttgtttgatcctgtgcatgggactgaacgtgatcgccgacgaagtaatcaatgcgatctggttctttctgattgcggtcgtatttcaactatctttgctatgcttcagtggcaatctactgctgatcgagagcgactcattgtcgagctgtgtgtactcgatcgattggcacacgatgccggtgccggagcagaagctgctcatggttatgatcgcgcacgcacaaaagcctcaggtgctgagaggcatctttatgccactgatcatgtctagctttctgtcggtaagatcttaattcactatgaatatatgtttctttcaatgttcattactctttcttacgtttaggtaattaaagccagctactcctatttcacattgttgcattaa

SEQ ID NO: 182 - DNA, 1461 bp, Anopheles gambiae
atggatagtaacagtaagaaagatacatttcctctaattcagatttccactaagatgttacaaattatccgtttgtggaatgaatcatctgggcaaagaatgtcgacattcggtgtgctattgattgccgtgttcccaataatgtggcttatccctagctggttgtttatagtaagctcgcaggacaatatcaagcgtttgatgaaggcgatcaacgaacagatagtgttttgtatagtgtttttgaaatttagcttctatgcaattcattttcgtcgttgggagcagttattttacgatctgcaacgttcgttcagcaccgttgtgaacaatcccagtctcgagattcaatccatattgggacacgtaacgaaatcgacccataagctcactaaatactattgctctatagtaagcttcaactgtgctgcgtacggcttatttccaatgttgttcatagtggttaaatatgccgtgacgggctcgtacgacgtaccgctttcaacaccgattgaaggaaagtgagtataaatttgaagattgcccaaaaactttaatttagaatttaattctgtttgtcttgcagctattctatccccggttttcgtacaaacttttgggtttggttgccctttaatttagcccaaaatgtggtgttgcagtgtcatagctttgctgtaattaccattgaatgcttcacatggaatcttgtgtatgccacatcctgtatgtttcgaatcctgcaaatccaagccaccgagcttttagatcgaagtcgggataaaaaagaatggaacatcaagtttaaaacattcatagctctgcatgattctgtgctgaggtattaaattaattttgtttgaataatgttttcttcagctgtagtgctgtgtcttttgtaacagatcggctaggacacttgaggcaattttgagcggtcagatattattactttatgtttcaacaattttggctgtatgtcttggaatggtagtgctgaccctggtaagttgctgtgctatgttactagcagaagttcacctcaacccctgcatttattttaggccatcgaagatgtttatctcctgttaacaacgtttgtcgcatttggctactgtatgtttcaaatgttttccttctcttatctcggcactgagctcatagagcaaagcgaagcagtagcggatgggattttcaatagcaaatggtatgaggaggatgtaaaagtacagaaagatcttagcttcgtactgatgcgagcaaagaagccggtaagattgactgcagcaaagttgttcgttgtaacacgtgactccttcacccaggtaaggcgtgaaccttatatgttattaactatagtttctatcagttaactgctgttttgatattttgtaggtaatgaaacaggcgtacactatatttgcattgatgtcccaatttctggacgacattgcgaattaa

SEQ ID NO: 183 - DNA, 1472 bp, Anopheles gambiae
  modified_base (1374): A, C, G, or T
atgaagcctagctgcaaggaaggtgtatttcccttaataaacctcagcataaagctattgaaaatagttggtttttggagcaaaacgacggggcaaaggatttcagttattggtttactggcagttatattgtatcttttagcgtggcttatcccaaactggctgttcatagtgagctcgcaggacaatataacacgactgataaaagcgaccaacgagcaaatactgtactttattgccttcttcaagttgtacttctacgtaatacattatcgacgctgggagaagctgttttacgatctgcaaattgcgtttagctcggttatgaccaacccgagccccgaaattcaaggaatattgggacacgtaacgaaatcgacccataaccttaccaaatactacagttatgtagtaaatttcaactgtgcatggtacggtgtgttccgaatgttgttcatagtggttaaatatgccgtgacgggctcgtacgacgtgccgctttcaacaccgatcgaagcaaagtatgcaatggcaaataaaacttaaaattagtgaaacactgtaatctgaaattgtgataatttgttttgcaggtattttattcccggcctgcatacaaacttttgggtttggttgccggtgactttaggactaaatgtactgctggagtggcatagcttagctttggttttcgttgaaaccttcatatggaatcttgtgtatgccacatcctgtatgtttcgaattctgcaaatcctggccaacgagctttcagatcgaaaacggaatgaaggaatatggacagtagagtttgaaaaattctcaactttacatgattctgtgttgaggtagacaataaaatcaaatcgcaaaatcctccagatgctacagtgaagtgtgtttttttttgtaacagatcggctgggacactggaggaaattcttagcggacacatgcttttgctttatgtatcgaccatattttccctatgcctgtcgatggttgttttgtctttggtaagttgcagttatatgttgttaagtaatcttttcttattaaacctctttgttttagcccatcgatgactttattttgctgctaacaacatttgtcgcatttggctactgtatttttcaaaccttttccttctcttacctcggcactgagctcattgagcaaagcgaagcagtagcggatgcaattttccacagcaaatggtacacgcagaagctgaacagacagaaagacatgtgtttcttgatgatgcgagcaaataagccggtgaaattgactgccgccaagttgttcgttgtaacacgcgattccttcacccaggtaaattgtgaattctttgcactgaatgttttttttttnataaactaacaatccttttggtgtttttgtaggtaattaaacaggcatacacaatctttacattgatgtcacagtttttggacaaccctgtgaattaa

SEQ ID NO: 184 - DNA, 1821 bp, Anopheles gambiae
atggcccgtttggtactgcacgaggtgcgctacgtgttgatggcgatgctttacatatctcggggtatggcaacaaagattcaaaattccccaattgatctgtacgtctactggtttctgacgttcatcccaatcgcttcgctgtgtgtaccgcaggtaagtgtgtgacccaccttttcgcgattatccgtgctgcttgcgccgcagagtatgcaattcgcactgcatggtgagagtgaatgagacgacctgttgcgatgcagtggttagcaactgtttttcgtatggcaatcgtgtgttttcttttgtcttcagagttatattgtctcctttgttcattagatcatttttcgtgtgaaaatgctgaaacaaacaaaacaaataatccatttttacctttcgctacagttcacttacttagttgtagataccaaaagccttatagatttcatctcagtactggtacccattacggaaatcctgctaacgaatgggaaaatgattatatgtaacgtaaagcgggggaaaattatcaatctcatcaaccaggtccaggtggcatgggacgaatgtaagtgagagagtcaactgttacgaataatgttgtgaataatttaaccgttctgctaggtgcaaaatcggaacacctggaaattcagacattgattacgaccactgccaaaaagtcgaaaattttcgtcatcatctacacgacctctttcctgcttatctgcgtcgagtatagttcaatgccgttgttcaagttgatctaccacagcgcagtttacggtaagcaatccaactacactatcgctctaccgtacttgtccaggtgagaaacaaattgagaaacaaaactctcagcataattggaccattccatcggatttagagtaaatagacactaaaactgtcgtaacacttttataatcattcgcaggttcgcttatagtacagagtccacgaccagctttgcgtggacgtatttcttcatactgatcggagtctacttgctggcgctaacgctcagtggctttgatagcttgttttcgacgcttgtcatgcacattaaaatgatgttcaaggtgttgaagtttgaaatcgagcagctgggactggatctgagtgccggaaagagtcatgtcgaactgcaggccaagctgaaacaaatcattttgaagcacaaaaccaatttatcgtacgtttgtagtaatactcagggcgtgccttgttgtgcattaattgttttacacggctttattttcagcttgatcgaacaattggaggatggtttcagtttctttttgatggcgcagtttctaaccagctcgattttggtttgcgtcgtgctatatgagctaactatggtagctgtttgaacattgatttgccttccccgcttgcgaaagattgatccaaaactgtttgttttacaggtgttcggatggaatgaggatacgttcaaaacggttacctacctgccaggcgccatcctgcagctctttctgttttgctggtacgcgcaacaaattaccgaggaggcgcgattggtgtcggaccatatttacaacattccttggtatctggccgatccgaagctgcagaaagacattctcacattcatggttaaagcccagaagcctaccggtgtgacggcgtccaaattttacatggttacgctgcaaacctttcagcgagtaagaactgttgggccttaaacaaatgtgcaaaatcttattttacctttttgtattatatttttagataagcagtacatcttactcctactttaccttactgcaaaccatcaatcagcaataa

SEQ ID NO: 185 - DNA, 1339 bp, Anopheles gambiae
atgaagctattccagattgacgatccccgtgaagtcgtcccgatcggttgccggctgctgaagctgttcggtctggggcgtgacgaaaagctgaagcttctctactgggtccagtgtgtgttttatctcgtgtttagtattataccacgcgtcttggtgcagatcgacgatacgataatggtgcttcggttgggctccgagctcgcctttgtctcctacctttactgccaaattttgggcctgtattttagacgcagttatctgtatcggctggtggatttgcttcaaacctgcataaacaaacagtactcggaatcgatcgatcaatttgtgatcaaatcgaataccaaaatcaacaaactttctgtgacttgctgcaaatattttacaattgcgtacgttctgtactgtgcgatgccaccgatagcatcgaccgttgtgtacgtacgcaaccagcgcaacaagacggccgaaccggaagagtttatcatttccagcgagatgaagtgcgtgtgaagtttcagttcatagtaccaaccgtctatttaaatccttttttatcttttcaagcctctactacctgaacattcgattcaatctgttgcacttttcgttttatacgatcgttatctgtctgctaacgatcacatccgccggttctctgtgtatcaaggacataatggatgtggccgtcatcaagaccacttgcttactattccaaacgacggccatgcagattcgcgaactcaaagataacatctcgcaggcacagctaagcgtcgtcatcaagtcgcatcgggacaccttgttgtgcgcacaatatctgcaggaagctctcaatctatcgcttctgtttcagctcacgttttgcagcttgatatggtgtctgatgatgttctacattttgctgatggtacgtgcaggatcgtgtttgaatcatgatttgactaaaacatcattgatttcttttcaggggtttgactccagaattctgaacgttctcatactactgcttatagtgacggtagagacctacacgtactgtacactcggaacgcagctgacagataaggtaagaaacacacaaccagatgcggacaaagctaacgtcatcttttttctttaactcaagggtgaagaggtcctgatggcgctccagcagctcgcttggtacgatcaatcgatcccgattcaaaagcagcttctcttcatgattcgacgctcgcagaaaccgatcatcctgagtgctggcaagattttctatgccaatgtactgcagttcagtgagatggtgcaaaagtcttactcattttatttggtactgaaaaatgtgttttaa

SEQ ID NO: 186 - DNA, 1391 bp, Anopheles gambiae
atgaagttcttccaaatcgacgatactcgcgagatactgccaataggttgccgattgttaatgctttgcggttgcccccgcagtgcccgtgtgaaccgcaggttctggcttctgggtgtttttttcttcgtcttcggtcagatcccacggttcctaattaagatcgacgagcctattgcgctggtgcgcgttggtgctgagattgtgtactcgacgtatatgttcttgcaactgattgcactgtacgctaggcgaagcgatctttatcggctaatcgatacgttgcagaagtgtgtcgaaaacccctacccggatgatgtgcgtgcgttcatcctgatcacgagggacacaatcaacaaatcttcagttatgtacagcaagtgtttttttgccgtctgcatatcgtacattataatgcccttcatggcaacgagtgccgttgtggtgcgaaaccgtcgcaaccagacgggcgaacgggaggagtatgtgatgcccactgaaatgaaatcagtaacgctaattgctaacctattccattggaaagaattttttaatttaagaaaccacgttcactctattttcgacacagtttctactacctggatattcgcttcaatctacttcactattcgctttactttggtgctgtgagtggactaagcgtaataggatcgctggcactttgcactaaggacgtcatggatttttcactcattcgtacggcatcgatgctgtttcaagcaaccgcccagcaaattcggaacctaccgccaggcgcatcgcaggccaagctcgaagccatcattcattcacaccgttccaccctgaaatgtgcagcacagctgcagaatgcccttaatcccgcactgctcatacagatcacattctgcaccgccatttggtgcctcatgctgttctacatacttctgctggtaatgtgtctgtgtgtttgtatgtgaagcatagttaacgaaagaggacattcacggaaagttttttgttggcagggattcacctccaaagtgatgaatgtgtgtttactgcttctggtactaacttgcgaaacgtactcctactgtcagcttgggacacagttcacctcaaacgtaagccctcatccttggggacctaactataaattatgaattcttgtaacttcactaactgtgccactacctccacaggcagaggaagtgctcgatgaattacagcaacttgccaggtacgatcaatccataccaatacagaaacaaatttacttcatgattcatcgctcccagacgcgtatcgagctgacagctgggaagcttttccccgtcaacattgcgcagtttagtgagattgttaaaaaatcatactcatactatcttgtcctaaaggatatcttctaa

SEQ ID NO: 187 - DNA, 1360 bp, Anopheles gambiae
atgttggccgctgagaccgttgactttttccgtgttcaatcaatctgcctgagagctattggcattgctcgaaccgattcgttccgtgggagagttctgttcgcggttagcttcttcaccgtgcttgtcatgatgctgggcacggtgatgtttgccttcaaacacatcgaccaaattatgctgctatgcgattgtctggggcccaccttcaccgcctacctggggctggtgcggcagtacaatctactcctgcatcggtccgagctgtggagtatcgtggacgagtttgcggcattgaagcattcgctccagtcgagcgaaatcaggatcgtgcaaaagtacaaccgcatcgaccggttcctcgcgtgggcttatttgattacggccatgtcaacgggagtgttattcgtgggagtagcgctagtgctggttttcctgtcggagaaatcggactggaaactaccgctgctgatggagtaggttgcctggggagattcccaagtccaagtgctctccactctcttactacccagctgtctttatcttctctttcctcgtccgtagcttcccatttgatgtgaaacatccggtgacctttacaattttctttgtctggtgcagtgtggccatattttgggtcgtgctggattgtgtggcgtgtgattccacgttcggtaccttttcctcctgcctggtggcccacttcgtcatcatccaagagcgtttcgaggggcttcgctttgacgatggtaaccgggagctgaagaaactcatcgaacaccacaagtacatactacgtatctccgatcgtgtcatcaatgcgtacaaaaatgtcattctgaatcaattgctcatctcatcggtactgctctgtatgctcggctttcagctagtcatatcggtgggtacgaacattatggtggtatatgtggcgtacgggatggccattaccatacaggttacctactactgctactatggatcacagctctactacgaggtgcacacatatccaaccaatctgtgggaaaactagagaaactaaatccccttctttgctgtggtcaatttcaattctagagtacacaggtgcatgatgctgtcttcaaaagcaaatggtatgatgcgagtgttgccacccaaaaaatgttgatcaactgtatgatgagagcgaagaaaccggtgaacgcaaagtcgggctttacgcaagcatctttgcccgcgctgaatgcggtatggtggcaaaacgtaattaaaaacgattttgagtaagtgaccttttgtggttggtgttatctcttttcagattttaaattcagctggatcgtacgtagctctactgatgtctctgatggagtaa

SEQ ID NO: 188 - DNA, 1369 bp, Anopheles gambiae
atgtctcagctcaatgaatttccggcctatcaattccgattgattcgtttctgtggtgtcgtggaacaaccatccttaaaaaacaatgtgcgatgtttgtttgcatttattctcctttgctcctttggaccacttcatgtatggtatctcgctaaaactcctgtgttggatctggtggtaacgtgtgaagagatcatgctcattcaactgtgctttgttatgctactcaagtttaatttgttcataacctatcgttctggaatgtataatttggtagaagcgttcaaacgcattctgaagtgtatcgacaaagctgagtttgcacggtttgtgaaatgcagcgagctgcatgcaaaattgctgagggcttacgtgatcggtacatctatagtgctgttattgtacgagctgaacgcaatagttgctagcattacgctatccctgcaacagaacaaggtttgttttgtgacaccattcaggtatttattgttcttatgtttgttagaaagatcgcaacgtcctgttataaatttagtccttttttgtaacagcttcccatttgactatcaacatccgatcgtgtttgctcttacttttttacacaactttgatgcaatgctggtaaccgtgtgcacaagcgttacggttgactcgtgtttctccgagatggccagtaatcttactatacatttcgatatcgtgcgagaacggtttgaaaaactcgatctttccgctgctcaaccgtatgccgaacaccagttaagaaatgtaatcacctatcaccgcgaagtgttgtcgttggcgcaaaagatggtacaactttaccaacagtcggcgttttatttgctgctgttagtatctacaatactgtgtctgttgggctatgagtttgtaatggtaagcaacatttacaagcgaatgcaagttgcaatattggcttctattatgattgggcaagctgctatttatacctaccacgggtcagctatcagcgccaaagtgagtaaaaagtataattaaaagcataataccataaataatcttacgtaccactgtagagtgtatccgttgctgatgcaatttatggaaccaactggtatgatgctcctctagccgttaaaaagctggtatatatctgcttgatgcgagctcaaaagcctgtcattatgaagagtggcttcatagaagcatccttgccgacactgaaaaaggtaagaacaatgtgtctgaatactatttaacgaaatgatgaaacctatttatctatgggtttggaattaaatttaattcacagattcttagttccagtgcatcgtacataactatgcttatgtcgcttgaggctgacttgaacgagaaaaaaacttga

SEQ ID NO: 189 - DNA, 1400 bp, Anopheles gambiae
atgtgcatcctggcggggttgctgctaacgctggcgaaaaagtggcactgcgtgctgtacattgacgagctgtgggagtgcgtcgagcagatgcagacgtaccacgagcactacctgctgcagggcgaatggtttgtacggcgcatgagacgccagaacttgcaagagcggatgttgcaggatgcatccaagctgctcgccacactgctcgccagctgtctgatggtgaacgtaaggatttatggcattttagttcaagaattcactatctttgaggatggtgtgacatatcatgagactactgcttaaataaccaatgatatttatgctttttaatataaggttctttaggggatgtctctcaggtctacggctcattttttattcaacccaatgttctttaggcactcttttccaacggcgaaacgcttatcctgcgtgccatctatcccttcagcacggccaccacgcttggctacgggtgtgtgttcgtctgtcaggcctttctgatcgtctacgtactgtacagcatggtgctgatcgattgtatcggcgcgcaagcgctcagccagatggcgctactgttctgcatgcagcgcaaacagttcgagctgatcggggccgatcttcagctgccccccgagggccccctccacggagaccggtcgatacgggaccaggtgtacagtgcgatagcttcacaccagcagttgctgtcgtaagtattggtaagactcgtatgagtttggcactcttttctaccccggagcgccctctactcttcactggcagcttttgcaatcgcttaaagcgcctgtacgaaccaaacattatggcccagtttgtgtgcagcatgctcatcatctgtctgaccgcgttcgagctgatgtttgccaagggcgacccgatgcagatggtgcgcttcggtgcgtacatgctggccggcttctatcaggtctttgtgtggagcttcttcggcaaccgtgtcaccaatatggtaagtagcgggtggcagacaaacgaagaaagaatccattcaaaaaagtatcttttgccacggatttgactatcctgcattgcagtcaacaggcattagcgatgcaacgatcagctgcaactggatcgtgctggcggacgggctgaagaaggaccttcgcttcacgaccatgcgctcccagaagccgttcgtcatcgacgtgtactggctgtttccgctgacgtatgaaacgttcatcgcggttcgtgtttcccgagggcttacgcgaaagcaaaatagtttttgtgaagtttttcttttttgttcgtttctttctccaacactccaacatactatttcacacttgcagatacttagccggtcctactcgatatttacgctgcttcgtacgatgattgagtga

SEQ ID NO: 190 - DNA, 1410 bp, Anopheles gambiae
atgtacgaccctggtcggttcatcttcccgatgcgcttcagcatgtgggcctggaaggtgtgcggcttttttaacgcaccggtaccaaagtccgtcgcgtaccgcgtgtactgctacgcgttctactcctgcatcatggcggtgtacctgtttgtgctgctgttgaacgtgttcgtaccgcaaccgttcgagcagcgggtgttcttcatcatgtacatctttctgaccgaaacggccatgatcctgaaaacgctgaccatttatcggcatttcaacatcgtctggagcctgtacgaaactacgctgggggtgtcatttcaaccgcgtgacgagcaggaacgggagctgcagcaacgaaggctggccgtattcaaccggtggtactatgcgtacatcttcgtgagccacatggccgcattcggtaccgggagccatttgcttagtgctgagtatcggatgccgttctttccgtggtttttcggtgtcccgtactgggaggatgcacacgtggcgtactacacgatctgtgcataccagagcttcgggatgtactttcacatgctgctcaacacggccggcgatacgcagctgtgctatatgatgcacatgataggcatccagctggaactgctgggaaaacggtttcgcgatttaaataactgcgaagagttcgatcgttcgtttgtgccgttggtgcagcattacaacaaaatacatcggtgggtttgatgggttaataccacgtagcctttgcgccatatgagcaatacgcaatgagccacgtggcattaggaatggattgcttttaatttcctttcctctattcgcagcatgctgtgtcgagtacagaacctcttctcacctgcctattttgtgcagttcagtgttagcgggctggtcatctgcgcttcggcttatcaggtagcctcgatggtgcgtatatccaacaccttaccttatcattggttaacattcgccaatcgccattagtaacgcacgtgtctatctgtagctcaatctaaacgacttcagcaaactgatgaacgtgttctacatgatgtcgatgacgatgcagatcgggctaccgtgttactatggcaacgaagtaacactcaaaagctacgccctcacgaatgccatctactcctcgcgctggtacgacatgccgcaaagcaacaggaaaagcgtgcaaatgtttctcgtgcgcaccaacaaaccattcgcagtggctgcgtttggttatttcaactttaacttgcccgcatttacaacggtaatgcaaacggggaagaacaaaaattggaaggtacaacttactctaaatacatattctattcatgttcgttgcagattttaaacatggcatattccgtgtactgtgtgctgcagcgtaaagcaaaaaatgtgtaa

SEQ ID NO: 191 - DNA, 1387 bp, Anopheles gambiae
atgagctgcgtggaagattttctcgacgcccaaatgtggtatttgcgctactgtggagtgtttcgcgagaaaagcgcgctcggtggaatccggctgagcgtctgtctcggtgtcctggtcgtgtttatggtgctgcagtcgatctacatattccagcacgtgcaccacttcgccatgatctgcgatgccataccgacgctggtcgtctgcatggtggctatttccaagttctacatcttcgttttccacccggccgccctgttcgcgctgattgattcgttcaaagcgctgcagcggcgggctagcagggaggacttgctgctgtttcggcgcagcggagcgtttcatgcgaagctgacgaaaatctacatgacatcggcactgattgtgggttggttctacatactaagtgccatcgtctcaggaatctcgcggtcattggcggaaggacgggttcattttgtagcaccgatggcgtacgtatccgtccgaacgcgtggacgaagccgatttcagtgatgtgtgtgtgtctggattggttttgttttttcttctttcccttccttttcgaaactagctttccccacaactatcagcatccgctcatgtttgcgttaacgttcctgttcaactgtgactccatacacatgagcatcttcattatcggaagtgtcgatacgtgcttttccgagctggcgacgagcgttacgatccactttcagctcatccaacgccagttccaggcagttgactttgcggctcgtaccgccgaagacgaactggaggtcgtcgtggcgtaccataaggatgtgctgcagttgtgcctggccatgacgaacctcttccagtacaccgtgttctacctattgctgctagactcggtgctgctctgcgtgattggctatcaatttgtgatattcatgaacacgccgcgtgtccttatgctggcgtcgatggcgttcgttatggttttacaagcggtcatatattgttaccacggttccatgatgtacgatgaggtactgtggttgggagggcgctttaacaaagaaaaatggccccgtctagcactgtcttttttcttttttttataccacgttttacagagcttgaaggtggcggacgcgatttaccagagcaattggtacgaggctccaccggcggtacagaagcggctgcgattatgtatcatgcgagcccagaagcctatcgtcaccaaaggtggcttcataaaggccaccctgcccacactgaagaaggtgtggctggggcactgataagacttttgcgcgtagtagcatgtaatgatatgcaaatttcgttacagattttaaactcaacgggatcatacatcactatgctgctctccttagagacagagcagtag

SEQ ID NO: 192 - DNA, 1309 bp, Anopheles gambiae
atgcagaccggtggcgtgctgtcgcgcatgaggcgtgccctggggcgcttttacgtggagcgtgattttttccgcccctacgagatactgctcgccctgccgggctttcatctggtggaagagtttcggacgagtagctggaagcgggcgctgttcctgctgtcgcgcacggtgcagctgctgcagtacgccctgtgggccgatcggttctatctggcgctggtggatccgtccagcccgcccggaaaggccctgcactacggcaacacgttcggcgtgctgacgatgatgctggcccgcatgctggtggtgcgctggtatctaccgcacgtgcggcagctgatggagtatctgcgcagacagcggggtcgcatcgagccggcacccgatacgcaccggctgtcctatcgccggatcgtcaacatagccatcaccttccagctgatcgggctggcggatcggctagtggctgggttctcgcagacgtaccggcaggagctgtacgaggtaccggcgaatctagccgagctccaatggccgatggtggtggcggtgcacgtactttcgtttgactttgcgagccgctggggcgccgcgtacaacgtgtcgctgacgggcatgaactcgatcatgatgggactgtacgacgagctgacgagcatcgcgcaggagtacggtcgactgcttacgaaggagaagaacggtcaagcggacatctggacgtcctttgagcgtaacacggcgcgtgcggttcggcggcacgagacgttcctgtggcagctgggacagttgaaaccgttcctgcagaccacgttcctggtgatgttctactccgcggcgctatttctcgccatcggcaccttcatgatctcggccaacgggacgacgacgtacggtgtcattctgagcgggttcctgtttgcattgttgctcgagtgctactggtgttgtcagctggtcgatcggctcaatgaagtggtagcgggaatcgtttacaacagcaaaactggcaaatgatttaccaccttatcggcattcgtaccctgtttttctttttttgcagaacacacaaattggaattctgctctacagcctggactggccggtggagctgcagtatacgaaggcgaccgcaagccgctatcggcaggcccgctcctcgctgctgatcatgatgagtaagacgcagaagtcgctcggcattcgatgcggcggcatgttcgagatgtctagtgaagcgttcgccagccttgtgaagctaacctacaccatgctgatgtttttgcgcgacacacaaaagccgaattaa

SEQ ID NO: 193 - DNA, 1431 bp, Anopheles gambiae
atggaggccgaaaagcaggatacacctaccagcgatgatccgtaccgttggggcgactacatacgccccgtcaggataaccgtgtggacctggaaaatctgtggtctttacaatgggaagccacagacaacacggtaccgtgtgtaccgtgccgtgttcaacatcttcctgatggtagtgtacctgttcacgctgtcgctcaacgtgttcgtgatgcaaacgttcgagcagctggttctgtacatcatgtacatcgtgtttacggagattgtcatggcactgaaggcgatcgtcacctactacaagttcgatcagctgtgtgacctgtaccgccagacgctcggcagtgactttaaaccgctcgacgccgaagaagaacagctgcaccgcaagggagttgcaagtattaaccgctatctgtatccgtacctcgtgacgacgaacttggccgtcgccagttcgtgcctgtacctgctgcaggacgattacaggctgccctactttccctggatactgggcatcgagtatgggccgacgaagcgtcttaactatgggctgctgtttgcttaccaggtgatcggcatgtatctgcacatgctgatcaatgtagcgatcgacgtgcagctgtcctatctgctcgggatgatcagcatccagctggatttgattggcaaacgtttccgctcactgcacacgtccgaacagttccgggagtctttcgtcggcttaatgaaccaccatggaaaagtgcaacggtaactaagcaacgtcgcgttgggtggtgctgagaacgaagcaggcggcattcaccaattcttacttgtcacattgctttcatttcaaacaggatgaccgctgaaatcgagcagctcttctcggcggcatactttgcccagttcgggtcgagtgggttggtgatttgtgcgtccgcattcaagacatcttcaatggtgagttccggtggtcgaaggtagcgccgaactgtaactgtctaaaagtaagtacgacatcgacgatatcttaattccagtttaacctgtacgagctgaccgccatccagaacctgctctacatgctgtcgatgatatttcaaatgttcttaccatgtcgcttcggcaatgaggtgacgcgcaaaagccacctgcttcggacctccatctacagctcccgttggtacgagatgggattgcaggagcgcaaaacgttgcgtatgttgctgcagcgcatgaacaaaccgctcacgctgaaggcgttctattttttcaactacaatctacaggcgtttactacggtgcattaacctagcgcggcaggaatttaaaaatgcgcttggaggctaatttgtacctctttccttctacttttcagacactcaatatggcctattcattgtacgcattgttgcaacgcaacgcattgaagaaagtttaa

SEQ ID NO: 194 - DNA, 1622 bp, Anopheles gambiae
atgattattaccgttgctccagttacggacgctcgccctcaaacgcctgaagactgcggcatgttcaagttccagcgtaagatcctgctcatcttcggctgttggccaccggatcggcttacacgtcgctggtatgtgaaggttctcatcgccgtcaatctgatcacgcttgccatctgcatagtgggcgagtttcggtactgcctgtacgcgtatcggaacggtagtctgatcgaaacgatcgaaagcatttgcccaactgttgccagattttctggcttattgcgtatgtgctggtttcttaggaacgagcataaaattaaaagcgctctaaacagtgtcgtccatttaattaagagtaagtaacagcgaacgttgcaccatatgagctagcaccgttgtaacagctctatttctaaatgtttgtttgaataatggacattcagtaatgcaattgttttcctcttctttttctgcctaacagatgaacatccacgtgaaactggctacacgaatcggatcacggcccgagatcaaacgataactaaagttcttttccattcaagtttcataactgcgatactgtatggcatcataccatactttatgatggcttacaactggttccagggccagtatcctcttgtgaagcttttaccgttcaaagttgtgtaagaagatgtcaaaataccaagagtaccacctaccatgcgcattattttttgtttgttactgcaggctacccttcgactcacaagatcccacgctctttgtactgacgacaattttcctcaactatgcttcggtacctaccattacggccatgacgagcactgacgcattgttcagtggagtttgcctttacatggatggccagtttcaagcgatccggctggagttggaagcactcgccgaaacggtagacaagtacacgctgaaaagctccgctgctgaaacgcttcgcatcaatctcgagctgaggcgcatcaacaagcgccatcagacgattattgacgtcgtgtcggaagtacgccacgcattcaccccaacgattctgatcgtgcacatctgtgcggcgttcatgatatgtgttataagcatggcaatgtttctagtgagtgcggaactcaccggcaagccgaatgtatcctgttttcacttactgttttcactaccgcctgcaggccgaaggaatcaacaagctcacctacatgccgtacacgtttacagtgctgatgttgctttttatgtactcgtacggtggcacggttgtgcgagaatcggtacgaactgtagttaagaattgcaaccaactggagccagcgccgatttctattttccattcttttcagagtgaagccatccaaacagtggcctacggtttcccgtggtatcagttcgatcgtaacacccgacacctcgtccagatgatgatggtacgggcaaagtatggatgcaatgtggacgtaccgttttttcgaacgtcgatggctaccttctcggtggtaaatccatggatagaatgctgtttaaagacttgtgcaatacaccgtttgcacttttcgttgcagatcgtacgctcagctatgtcatacatcacgttgatgaagtcgtttttgtag

SEQ ID NO: 195 - DNA, 1608 bp, Anopheles gambiae
atggtgtcgtttggtgctgcagcttctaatccacgggacgcggaaactacgccacactgggacatcttcaagctgcagcgaaagatcctgctcatctttggagtctggccagcggatcggttggtgcgcccgtggtatgtgaaggtgctgattgccatcaatctggcaacgcttgccatctgcatggtgggtgagtttctgcacgggctgtacgcttaccaggagggcgacctgagcgaatcgatcgaaagcatctgcccaacggtggcgcgaatatcgggctttctacggatggtgttttatcttgctaatgaggagaaaatccaccgcgtgctgaacaacatcagcaagacgctgcaaggtaagctgactgtcacgcctgcacatatgcaactggagcaacagattagaaagcgtcatccaaagaccagggagctaatgctgcgtttccaaattcagacgagcatccgcgggagcacaccatcaccaaacagctgacaacgctggggcaacagtttaccttttacctatttctgatgatgttttttgccgcatgtctctacggagttacacccttttttatcatgatctacaattgggtccagggacagaggccgctcgtcaagcttctgccgtttaagttggcgtaagttacttgtggagtcctattcttgcaaccatttttcaaacattcccacatctgttgtagcttgccctttgattcccagaacctttttccctttgtcgtaaccacactattcctgaactacgcctcggcacccaccataacctcgcagtcgggcagcgatgcactcttcagtggagtttgcctctacatttacggtcagtttcaagcgatccggctggaggtggaagcactcgccgaaacggtggacaggaacacgctgaaaagctccgcagctgaaacgcatcgcatcaatctcgagctgagacgcatcagtaagcgccatcaggcaatcattgaccttgtgtcggaggtgcggtccgcctttacgccgaatgtgctgctcgtctacacggccaccgcgatcatcatgtgcatcgtgtgcatcgccatgcttgtggtaagcgcagttttggcgtgattgaagtcgcattgaagttctttgcaaacggtcctgctcccgttccaatacaggtggaaggaatctacaagctcacctacctgccgtacgcgtttgccgagctgacgttactgtttctctactcgtacagcggcacaatcatccgcgattcggtacggtggtgcaaaaggcctagcttgcgagcagcaatcgtttaccatcgagcgtttcctaattcccttttcccagagtgaagccgtgcagacggtagcgtacgatttcccgtggtaccggtacgaccgcaacactcgccatcttatacaaatgatgatgattagggcgcagtacggatcgaacgttgatgtgcctttcttcgaaacctcgatggcaagcttttcggcggtgcgtcatgtgaaccgggatgatgcacaaacggctaccgcgaattacactacttctcttttcattacagatcgttcgtacagcttcatcgtacatcacactgatgaagtcctttttgtaa

SEQ ID NO: 196 - DNA, 1674 bp, Anopheles gambiae
atgttgcgaccgaccagtgaggacgaccagacgctgctgataaacttccgcctgctcgaacgcgtgctgcggcttatggccgtgtggccgacggatttcaatccctacctgccgcagtacctgcgcggtcggttcttcctttccgagctgttcgatttcggctaccagctgttctggtactttatctgcgtgcacatcgcggcctttcacatcatgtcggtgctgacgggcgaccttagctacgacgagctgttcctcacgctgatcactaccagcatctactcgatcctggtgccgctgagtctgtatctgcgcctgtacgaaagcaacatccggcagctgtacgagtttagccagcgccatttccgtaaacgttcggccgccggtgtgcactacatatcgatcagctccagctaccggttcaccaacaagtaccagttctggtggatcgcctcctgcctgctcggcacgatgcactgggcggtctatccgatactgtcgcaggagcgtacgctaccgtttccctgctggtacccggtggacgtgcatgagtcaccgatgtacgagctggcgtacatcttccaggtgctggggcagctgcaggtcagcctggtgtttgggttggccagtgccctgtttatggtgtttgtgtttgtggtgtgcacgcagttcgatatgctgtgttgcagcctctcgaatgtgcgccagtcggccatgatactgaacggtggatatgggccggagctgcgcgattatcaagacaactatgagctcgatacgcgcgactacgtcctgcaggaagtgttccgcgaagatctggacacggtgcaaggcaccaaaacggcatccaggctcgatcagctgagtcccgctcaaagttatctgatggaacttgcccctgaactgacctgcgtgatggaggactgcattcagcatcatctgatattgctgcgcttctgtcagctgctcgaaaactgctaccatccttacgtcctgctgaagttgcttcaaattctactgctcctttgctttctctccttcatggcaacggtggtaagtgggacagatatgcgagacaatgaaaagtttccaagttccaccaacagtggcaatgtgtcgagtgttcgtctcataacagtcaatccttttccctctcgctttaccaggaaagtttgtcgacgatgaagttaattaacgtgctcgagtacttcatgctctcgataacggaactgtatctgtactgctttcttggtcagaccctcaagaaccaggtactgcaacaagggacaatgtcctgctgcgcgacattgatttattgctttgatttgatggcagtgagtttgtgattcaacattttccgactgtcatttgtagggcttgaaggtgggtgacgcactgtggaagtctccgtggcatctgtgtggagcttcctaccgacgccggctggtgataatcctgatgaatgctcaacgaccggtacggttgactggtttgaagctgtacgaactgaacctggaaacgtattacacggtgggtggtattttcccgtaaggccgcggccaattgttaattgaaaatggctatttatgtcaacttctctctgcgttgtatgtgtgtttgcaggtactcaaggctgccttctcgtactacaccatcattaaaaagtttcgctaa

SEQ ID NO: 197 - DNA, 1390 bp, Anopheles gambiae
atgtcggagcatccgatacacaccttcgatcggctgatcaaacggcagcgcctgctgctgaagctgatcggcatcgatagctacgatccggcgttccgcatccactcgctcaccttcatgttggtgtgcctggcgctcaccttcttcgtcatctcgctgtacgacctgtacctgttccgggacgacctgttcaactttgtctacgtgctgatcacgatcttcttcgcgacgatcggcatcggccacatatcggtgttcctgctgtgcagcaagctgttggcggagctgctggagcaatcctaccgcacctaccggctggtggtggacgatcagcgcgagcagcgcatcctgcagtggtacaccaggctgttccagcgggctgtggacggctacacgctcgtctttatcggcacgtccgtggcggccggcttgctaccgctcgccatctacctgctgtccggcgaccgggtcctgccgtacggtgttgtgctgccgttcgtcgaccccgactcgctggtgggctacgagctgaactacatctaccaggtgagctgcatcatctggacgccgcctgggctggtcgcgtcggtatgcatgttgtttgggctcgtgctgaacatctgcatacagtacgacatactggcggtgaagctgcaggacctggacgagctgatacggtcgccgcacccgcacagggacgcgatgattgggtgcaagctgcgcagcatccttcgcaatcagcaacgactgatcaggtagtggggctgggcgaatcctgggatatatacagagagagagatagttaggagatactgtttgtgtttttttgttggtttgtgtgtctggacagtttcatcgccaacatcgaagcggcaaaaaacgtccattcggccgtggaggtactctcgctagggctgcagatcgttatcacactgttcgtattgcaattcgtaagtgtctccccccccccccccaacagtgcaccaacccttgggagctctctggctcgcttcatccatgtatttcccacccgacagtcactctggatccccgggctggtgttgataccggtcttcacaatgcagctctttctgttctgcctgctcggtaccatcatcgaggataagggcgtcaagttttcggccggcgtgtatagcctcacctggaacgagctgtccaagcaggacaagcagatctttcgcctgctgctgctgagctcacagcagccccagacgctcacctgcgctggtatgacctgcatcagcctgaacctgttcgtcaatgtacgtatacccaagctgggcgtgctttcggtctgtttaatgtgcccttccaattacagatgtcgcaaaagttctactcaatcttcatgatgttacgcaacatgtaa

SEQ ID NO: 198 - DNA, 1423 bp, Anopheles gambiae
atggaaacccatatcggaaagcaacattcgctggaacgcttccaagcgatggtagcttggcaaaaccgtgtactggccctgttcggatgctacatgtatctcggcaaagagcgagtgtcttaccgcatcgtgccgatctgctttatggcctgctccttcgtcttgctgtcgctgtacagtgcggtccaagccaggggcaatatgggtcaggctgtgctgagcattgtggtcctcttctatggtatcgtaggtgtgacacggttggcggtagcgatcagcaatccagccggttgctaccgatcgattcagatcgccgaggagatgtaccagcgtgccaacggatcaaatccggcggaatgcaatgttctggcgaagtacaccgacctgttctgcaaaagtgtgcaactgtacaccgtctgctttgtgctgagcgtggtagtgcttacgctgatgccctttgcactatatctactgcgtggcgagcgttacttgccgctagggatcgtgctaccctttactgctgaaacggatgatttcgggttttggtgcacactcgtcgtgcagctggcgtacatgtacacaggtccttttgggctgattccgtcccagaacatatactttgcgtttgtgtttaacatttgcctgcagtacgagctgctgattgagcggttgaagcagttggatgaaaggattcgaagctccaacaacctgaagctgaccgtgcgcgatcagttggtgaagatcattcagcttcagcaagagtctacaaagtatgcaaccggatcgagggtttccaaaaaaaagcaaaatattaatgctggcatcttattttacagctacattacacacattgagcgcttttatcagctgcaatcgttcgtggagtttctgtgcaactcgctgcaggttgcgctgacgttgaacgaattgcatcgtgtatgttggtctcgagacactccatttcctttgtgtggacaatcacatcctcactggcgtttgtatttcagaacttttggttgccaggattgttcatactaccgattgcagtgatgcagatgcttatcctatgctctttggggacgctgattgagctgaaaagcgatcagttcaaggatcagctgtacgatatagcctggcccgagatggacctaccggaacagggcatgttcaagtacgtgctgaaaagtgcgcagcaacctaaacaactgacgtgtggtcggttcgccgttatcaatatgaacctgtttctagcggttagtatgcgttgtgtaggaatttaatttaatttatttatacaaatggaaggatacaatggaatggtagacggcagcagattgatgaaattaatgcaagacgatgtacgatttcgtttcagattcacaaaaagatttactcattctttatgatgctgcaaaacatgtag

SEQ ID NO: 199 - DNA, 1422 bp, Anopheles gambiae
atgacgtttactttgtcgcacgatttatacgtttacaaccttcacttaatccggtggttcgcttcatttgtcggccttgatataatggctccgaactataaaccgaacattcttacctttctggcattttttggactatcaatatcgctaatcggtgaggtatacaccgtttggtacttctggcctattttagacaagctaatggaatctgcagccatctttggtgtcttcatacaggtaaatatcaggatattttcgcagcttcaaatatctgtatttctgataatacttaacagggtcttgcaaagttctatacagctcttcgttatcgcaagttctttgaagccatgtacaaccgtttagatctattccattacgaatatcggaaccatgaaaagaataatgcaactcttctcttactaatgaatcggatctgcttgctgaggaaacttattacatcacaattttctatctcaatcctaacattaatggttactcccgtggctcaatacatcctgaagggtgagcggtttctggtgtacaccattattttgcctttcaccgatccggagataacatcacactacctactgaatctagttgttcagtactatctcctaattgtaggattggctgggttttcagctgctgagaatgtgttgatactttttgtgaccagcgttgctggatatgccgatgtgctcaaaaataagatcaatgaaatgaacactttattgctggatgcacagaattcccgtgaccgtacgtcagtcaagttaaagctacgtgagattgttttgctacatcagcgtgttttggagtaactatacatataacagagtttgttgattctactattcataattctgcttgttgggtttcaggtacgaagatgatcttgacaagcgttactatctcaacaactgggttcaggtggcctcaagtattttcaatctcactggtgcattgtttggttgctacgtcagcaatagttttaccatgtacgcattagcgatcactattgtaattcaactgtttgagctatgtctgctaggaactatcctcagtataaaggtttctattgatatcgagttgcaacagccatatcagatttaacatctattaccattattttccagaatgaagagatcgagcatgcattctatgattctttgtggtatctgatggatcattctgagaaaaaggactttttaatcatgtttcacaaatgccaacatgccaaggaaatgactgttgccagtatggcgccgctgaatatcgttctttttattgctgtaagcataacatagtcatacttccttaaaattggggaccttactatagcctgcatacgtaactttatttcagataatgcaaaagatctacgccttagccatgatgatgatgaggttttcagagtga

SEQ ID NO: 200 - DNA, 1441 bp, Anopheles gambiae
atgacgtttactttgtcgcacgatttatacgtttacaaccttcacttaatccggtggttcgcttcatttgtcggccttgatataatggctccgaactataaaccgaacattcttacctttctggcattttttggactatcaatctcgctaatcggtgaggtatataccgtttggtactattggcctaacttagttaagttgatggaatctgcagccgtctatggtgtcttcatacaggtaataaacactcacgaatatatcttcacagttcaaatttaatccaatccaaattatatgtactcctgatgatacatcacagggtcttgcaaaattctacacagctcttcgttatcgcaagttctttgaagccatgtacaaccgtttagatctattccattacgaatatcggaaccatgaaaagaataatgcaactcttctcttactaatgaatcgtatctgcttgctgaggaaatttatcacattacaaattattggttgcatcctagtcctgtctcttaatccagtcattcaatacatcatcaagcgcgaacgtgttctagtttacgctattcttctgcccttctctgatccggagataacatcacactacctactgaatctgattgttcagtactatcttatgattgctggaattggaggatttgcagctgctgagagtgtgttgatactttttgtgaccagcgttgctggatatgccgatgtgctcaaaaataagatcgatgaaatgaacattatattgttggatgcacagaactcccgtgatcgtacgccagtcaagttaaagctacgtgagattgttttgctacatcagcgtgttttggagtaactatacatataacagggtttgttgattctactattcataattctgcttgttgggtttcaggtacgaagatgatcttgaaaagcgttactatctcaacaactgggttcaggtggcctcaagtattttcaatctcactggtgcattgtttggttgctacgtcagcaatagctttaccatgtacgcactggcgatcgctgttgtagttcaactgtttgagctatgtctgctaggaactatcctcagcattaaggttgtgattgttaagaaaagatcgtaagatccgtattggaataacacatttgttacgattattttccagaacgaggagatcgagcatgcattctatgattctttgtggtatctgatggatcattctgagaaaaaggactttttaatcatgtttcacaaaagccaacatgccatggaaatgaccgttgccagcatggcgccgctcaatatcgttctttttattgctgtaagcatgacatacatccttgaaattgtatttttctaatgtgtatagttttacttttcccacagataatgcaaaagatctatgcttatgccatgatgttgatgaacttcttcgagtga

SEQ ID NO: 201 - DNA, 1218 bp, Anopheles gambiae
atgccacgtgcaacgagcaacagtgcagccaacttggaacggctggtgatacgcatctccagccacatggcggtgctgaagcttaacatcatagacccggcctggcgcccgaccctgcgcttcggtatcgtactgttccttaccgccctcgtaccggtgtatatctggcaggggatcaaggtgtaccggacacggttcgaaaccctgctagaggtcctgtctgtcgccggttgcggctggcagatgttcttccgcatgtacttctacctgttccagcaagaccgctgccggcagattgtgcaggaagtgcgcgaccagcggaccgtgtacggtgctgatcgaaatccccgcatggagaagttgttccgggctggcacgaagcgtatgctgttggcgtaccgcgtcatacatctgatgtacgggacgtcttacttctttcagctgggtccgctgatcatgcccgatccgcacaagtgcaacctgccgttggcgttgcaattgccctttttaccaccggatcgaaatatggtctactactgcatcaactacgcgcatcacttgctgctcaacacgatcggtgtctttatcttgctgccgatggatggtgtgctgatcgtggcactgctgaacatctgtacgcgtatcgctgccctgcagctactgctggaggagctggatgcgaagctcgggaccgtgcaatggcagcaaacggcccatctcgacgccgagctgaaccgcatcatcgagctgcacatcgacacgaagcgcttcgcgcgcgtcatctacgaaacgtaccagatgcactttttctccatgttcagcgtgctgtgtttcgtgatctgcatgtgcatgaatgtggtcgcccgggacccgcgcagtacgctgataccctttgggctcgcctcgacgggccagctgtttgtgatctgcatgctgggtaacgtgctgtacatcgttagcgatcggctgaaggacagtgtgtacggtattcgctggtaccggtgcacggtttcgcagcagaagaggctcatgtttctgctggccaatgcacagccggaaatcgtcatgggtgcggtgtttataccggttacgatgacatcgttcgtgacggtgagtggtcagagcagcccgtgaagtgggtgatttgacatgtaaaccgagcttctttcgttgcagatcatccgagcggcctattcttactttaccatactttattga

SEQ ID NO: 202 - DNA, 1439 bp, Anopheles gambiae
  modified_base (1148): A, C, G, or T
atggttgtgttcgaaccactggacgaccctttgaaggttctgccactgcctcttaaacttctggcactgctcggagtgaacaagaacccgtccgaacggttccgtctttacgccatatacatttacttgtgggtggcgatgttcataccgaaactctgcctgggatacgaaaccattcctcaatgcttccgaagcatcgccgagggtatgttttcgttcaacactaccgtcaccttcattatgttgcccctaaagatggacaacttcgaaggcttgcttcaaaatctacagcgttttacccaaatcggtaagcaatacggattatcatcgtaacatcgctcattacaactaccaactcttcactcatttcagttacagtcgaagaagactacaaacaaattctaatcagcctcaacacgacaatacataagttcaccaagttttacttcatcttcacaaatggggtcgtgttttccattaccggcagcacgatagcaggaatgctctatacctactacacgaaagattcggaatattccgcagcatttccgctcgtaatggaaaaccgtttctacgtgctggattcgcattacaacctaggccactgttttgtacatcaggctctgatgttctttgccctctacatcctgttggtaatgttcaccgccaaggccggtacgcttttcggtttgattcgcttctgttcgaccgtgctgggaatcattgtcctcaagatcgagcgactgagccagatcggacccgttgaccagtatactgcagagctgagtgaaattatcgaacttcaccagctggtgatcaagtgttcccgccagctgcagaacattctgatggaaatcctgttggcccaatttactggctgcgtgtttatatggtgctttatgctgtattatgttatgataagtgtaagtgaagtacagtttgataaaagtgacacaccgtaacaattctcatattggacgcattgtaacagttttgtttttctttgtctagggaataactgctgaaggtattgccgtgggagccatgctcatcgccttatctacggaaacgttcatcttttgcttgttggggaacgagctgacgttgaaggtaagcaattttgctgtctattacaaacttaatcattnattgcaaaattgaacagggtcttgaaattagtacggctatgtattccaccaattggtacgatcaaccggtcaagctacagaagatggttgtaccaataatacagcaaagccaacagcgaatcggtataactgcggccaagttttactacatcgattacaacagatacggacaagtacggtgctaaatttaatattctagttacaatccactgcaataattactgtcttctgacgttgcagagcctgaaaaccgcctactctttctatcttctgctgaaggacattttctag

SEQ ID NO: 203 - DNA, 1344 bp, Anopheles gambiae
atggttgtgttcgatccactggacgaccctttgaaggttctgccactgcctcttaaacttctggcactactcggagtgaacaagaacccgtccgaacggttccgtctgtacgccatctacgcctacctttgcattgcgttgttcatacctaaactctgcctgggatacgaaaccattcttcaatgcttccgaagcatcgccgagggtatgttatcgttcaacactaccatcaccttcattatgttgcccctaaagatggacaacttggaagacttgcttaaaaatctaaagcgttttaccgaaatcggtaagtactaatcaatacttcacttgctaaacgaacattactatggttctatttgctaattattcattcctttcagttatcttcaatgaagactacgaacagatcctgattagactcaacacggcaatacataagttcaccaagtattacttcatttttacaaatgggatcgtgttcgccatgaccagcagcacgattgcaggaatgttttacacctactacgcgaaagattcggaatattccgcagcatttccgctcataatggaaaatcgtctctacttgatagactcgcactacaaccttggccactgtttcgtgcatcaggctctgatgttctttgcgctctacatcctgttggtaatgttcaccgcaaaggccggtacgcttttcggtttgattcgcttctgttcgaccgtgctgggaatcattgtcctcaagatcgagcgactgagccagatcggacccgttgacaagtatactgcagagctgaatgaaattatcgaacttcaccagctggcgatcaagtgttcccgccagctgcagaacattctaatggaaatcctgttggctcaatttactggctgcgtgtttatatggtgctttatgctgtattatgttatgataagtgtaagtgaactacagtttgataaaagtgacacaccgtaacaattctcatattggacgcattgtaacagtttcgtttttctttgtctagggaataactgctgaaggtattgccgtggtagccatgcttatcgccttatcaacggaaacgttcatcttttgcttgttggggaacgaactgactttgaaggtaaggaatttggttgtctattataagcttaatcatttattacaacatataacagggtcttgaaattagtacagctatgtacttcaccaattggtacgatcaaccggtcaagctacagaagatggttgtaccaataatacagcaaagccaacagcgaatcggtataactgcggccaagttttactacatcgattacaacagatacggacaagtacggtgctaa

SEQ ID NO: 204 - DNA, 1426 bp, Anopheles gambiae
atggtaaaccttttcgcccggacgccggccgacaacttccgcgtgatgccgtacaatctgcgcctgttcgcgatgctcggcctgtggggcgaccggcgcaagctgtaccggctgtacgcgctgctgctgcttgcgtacgtggccatcatcttcccgaagccggtgcgcatcaccgaccggcacccgttcgagtcgattgtgcgaagcgtgtccgagctgatctttgccgcgctctgctacctgacaatcatcatcctggccatcaagtcggaaccgttccgggcggtgattcgcaagatggagcaggcactggagctgtgtacgtgcgcgtgtgctcgttgctgtggttggactctgattcccgtaacaactcaaactccaatctttcccctctgcagttcgcgacaagcaggaccagtgcagtcagctgatcatcgaggtgaacgctaacattcatcggtttagcctcggctacgccaagttgaacctgctgtacgtactgctgttcaatgtaattccaccgatctacaactatccgcgctacttcctccagtggcgcatgccggaggacaaccggacggtcgagttcatgctgcccctcatgcaggatctgtacgggttggatgtacatcacaacatcgtgcactacaccatctcttgggtggccatcacaccgttctgtgtgttctgtgcgcttatcctctggttcaagggtgcactgtttatgctgatccgctacaacacactgctctatcagctcgtcaaccggctgctgcagcagtacgatcgtgagtcggccgggggacttttggcgcagaagcaccgccggctgcagcaaattgtccagctgcactaccgtgcgatcgagtgtaccaagctgctggacagcatcctgagcctgatactgctgatccagtgtgtcgggtgtttgctgatgctctgcctgatgctgttctacatcacgcgcaaccacagcttgaacgtgatcaacattgcagtgctgctgatgtccatcttcatcgagatgatgtgcttctcctacctgggaaaccagctcacggaagaggtgatcacgttcgcaatgctttaaaagttatgcagcagtatcattgtgtacgcactcttttccttcccctagaatgctaacatcagccattccgccttcaactgccgctggtacgacgagccgatcgtgatacggaagtactttctgcgcatcatcctgcaggcccaccgcaaggcgacgataacggccggcaagttttacaacgttaacattgtgacgttcgcgcaagtaagtaccgctctactagttattccacaggccgctctcctcgtgctctgtctgatcgtttctacgacgctctaattacagcttattaaaacctcctatacctactacatgatcatgaaggaaatgttctaa

SEQ ID NO: 205 - DNA, 1513 bp, Anopheles gambiae
atgttccgacgcttaacgcacccgacctccccgaagcagcaacaccatcgtgaccgcgcgtgtgacttcaccgtgatgccgcacggcctgtggttgctcgagcactctggcctgtggggtgatccccgacgtaagcgttccttcgccctaatgctgctcggcacggttctgctgctgatcgtaccgaagattgtgctcggcaccgggagcgatagcttcgactcgatcgcccgcagtacggccgagttcatcttctgctacaacaactacctcatgatggcgatcttcgccatccggcggcaaccgttcgagcagctgatcggcaccgtccagctgctgttcgataagcgtaagtgtgacagactgactggatgctcgcaacacgtacagtgaattattgcaaactctcccaacttccgctgttgcttctcaaacggtcgcgatcacacagaacgaaagttccagacgaccgactccagccggtacgtggtgtacgtcaatcgacaaataatgcgctacagccggctgtacatcatcgtgcagggcgtgtacttcctcattttcaatctactgcccgccattgtgacgtacagtgcgtacttcgcatctagcggcgacggcgagccggtcgagtttctgctgcccgtcgagtcccggttcttctttctggacatacggcacagtatcgtgcactataccgtcttctccctgctcgcctgtccagcgtttctctttaccgcgtacctgacggtggtcaagggattagtctttatcggcatcatcgtttacaacacgctccagtatcagctcgtgtcgcgaggcgtccgggagcttaaatcgcttgacccaaccacgacccagtttcgtcaccggttaacggaaatcattgaccagcacggagcggccaccaggtgcacgaagctgttggacagtgtgctcaacctgatgctactggtacagttcaccaacaccgtgctgatgtgttgcctgttcctgttctacatatcaaaggtagggcaggttgattcgtgctcaagggcttctggcatacgtacaatctaattacatcaccttaattctcagaatttcaactcgggcgcagtcaacgtgctgctgctgtttctagcccttacggtggagaatctatgtttctcctacttcggcaataggctgtcgacggaggtaaattgaactttagtctacagttttgcataaatttcatttcccaattgatttgcagaatacttccgttgctatagcggtttacagtacggattggtacaactatccgccctgtttgcaaaaacagttccaacagatgatccgtcacgcctacataccgcgtggtattacggtgggaaagtttcatttcgtcgacatggcctcatttggacaagtaagctagaggtcccaattagcttcctcttggtcctcgtttgacaatttcttctttcatttttagctgctaaaagccatattctcatactatctcattttaaaagagctgttctag

SEQ ID NO: 206 - DNA, 1415 bp, Anopheles gambiae
atgttgagtctacgtccagaagatccaaaggcagttatgccgtttgcaaagcgtcttcttcggctatcgggtttcagtccgggtacagaacagcttggaagatgcatctacgtcaatctgtccatctacattactgtgatcttggttcccaaagtgtgctttccctatcccaacaccgaagccatgatacgtggattaggtgagctgatttatttcaccaacgtttacgttggcttcttctgcttcgtcgttcagcatcgccactacagagatctgctcgatgaaattcagtccttcgtaaatatcggtaagtgttcgctttgaaagcttttttttccaatagtgacattgtattgttctccttccctgaatcaacagtatacccaacatcccaacaaccggaatcactatcagaacgaaccttaatcaagctaaacgttaagataaatatactctccgtgctctattgtcgctacatagtagtggcagcctttatttactggatggtaccatgtgttgtaacgtacagctcgatacacaaagcagaagtgagcatgggaaatgaatcgatccagtcgatacaatactacccgaacctggaggaatcgttttactggcttgacaatcgtagctctgtgagcggctacgccgcgtttagtgcagtggcattgatagtctttgcttttgcttcgtataatcatgtgacaaagcttctaacgatcctgtccacgatcaagtactgtagcactctttttcacctcgtcagcatcggtatcgatgagttgaaccttgtaagtccagcacacatcgatcgagagctaaaaaaactgatacaaatgcatcagctggcaatacggtatgctacttccactggacgaattgtctcacaacgacagaagatgaccatttttcttacctatcactttcgtagctgtgacgtcttactcaaccaaacgttaagctatgtaatggctctacaactcgccctcggtacactgacatggtgcttcacgcttctatacatcctgatcatcggtctggacgtaacggcaatgatgggtttgctaatcatgatgaacatgacatcggaaatgtttggttactgcttattttgcaccgaacttacaaatactgcaacgaccattagccaacagatctacgtgtttcaatgggaaaaacacagtccggcggtacagaaaatggtggcgatgattatcgcccgtggccaagcaccgctgcagattaaagcgtgtggctttatcccgatcaatctcgaattgtttgctaaggtaagtagtagtggtagcagcagcattacagatcatattatgtacaggaatatttacgaaaatccggttttgtaggtggtcaagacatcttactcggtgcttattgtgctaagggattttgtgtaa

SEQ ID NO: 207 - DNA, 1493 bp, Anopheles gambiae
atgctgttccaagcgttgccgaacgatcgtgccgtactgccgttgctcctgtacattcaggagcggcttgggctttggggtgaatcctaccgggcacgctttctgtttgttgttgtggcgtttagcattactgtatgtattccgaagtttactactacctacaccaatctggaaacgttcatctgctcgatggcggagcttgtcttcatcgggaatgttttcggcggtgcgatgctgctctggacagagtacgatgccttcagacagtttatcgagcaagtgaacagtttgacaaagcactgtaagtacgcttgagatatctcagttaggaatgtaatttcaacaaagccttccccatttttctgtttagtttatagagaggatccgctgaaggagcatgtgttgcagtttaattatctaatccatcgctacaccaacagatactgtttctcggtgatgattttaatcatgttctaccttgcggcaccagtaataaccagcttcgtggtatactttcaatccttatggaaatcttaccacctagcaaatggcactgtccgtacctgggatatttcacatcgacaattttccctccacatggagcaaagtttctacggactccagcatcggaccaacattcttcactacacactctacatcgcagtcatagtgccgatgatgttcgtaacagcctgtaccgtgcatatgaaggtgctgactattgcatcttctgttcggtacgctgaaatgctgctccacattgtgatgcttaaggtagacagcctacccaaacagaagtccatccgcgaagaactgcatgacattataaaagtacatcagcggacactcgactgcatcgccctgctcgtgaaggccctacggcccgtcctattattacagctcgtgttttgcgtcttaatctggtgtttgatgatgctctactttaccattactgtgagtaatactgcacgtttgagactgttttgtgcatagcaactaatggttggcccttttctcataaggatggcttaagtgtaaaatttttcaacatcggaataatgttcctcgtcatcacgatcgaaacgttcagtccgtgttattttggaacgcgtctctctacccaggtaatgttgtatcacatctgacgtgtttgttttggctgttaatcagcaacattaacttctcatatacacccacgaggagttataggcagtggagctttctgagagtgtgtatgcctgcggatggccagcgatggaccgcgacatccagcagagactgcgcatggtgctgcatcgcacgcaatcgccggtcggcatacaggcaggtaaattttgcttcgtcgatatggaactgtttcagaaggtgtgtgtagcgattgtctgcattaactaactacatcaaattaatgttttttgcacgagaatttctatcccttgcagatggttaataagtcctactcctgctttatcgtgctgaaggatgccctctag

SEQ ID NO: 208 - DNA, 1526 bp, Anopheles gambiae
  modified_base (1)..(214): A, C, G, or T
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcactcaccccaaccgacgcaggtgtgcagctgcaaactgaacggctctggctgcgcgccctctttctgctctaccagctgctgctgccgacgcaggccatcatctggctgtggcgtacctgggcggtggcgtacatcgagcacaacaagccgctcgccatcagcctgctgtgcggccagttcgccctcaccagcatagtggcgcggtacatgctgctacttcgcagctacgcccagctgcagccgatccagcgccacctcaacgagcagcggtttctgcggggccacccgcgagcgcacgcactgcggcagcaggccttccgcaccaacaacgtgctgatgctggcgctgatggtgtacggcgtgctcaacttcgtcgtgtacgaggcgagcggtctgcactggcaggagatattccgcatgccggactacctgctggcgacgaaccggccgctcacctggacgctgcacctcatcatgcgcccgatgacgttcaacgggctcggcgcgttcattgcgaccttcgtcagcatacacacgatgctgaccgtgctgcacgccgagctgctgctggtggaatttgcgtttgacgggctgctggagcgagtggagcgccacgttcaggctgccggtgcgcaggagtcgccactcctctggcagcagttcaaccgcgagctgggcagatgcgtccgcgagcattgtgtggtcctgaagtatgttgcgcgagtggagatttggcgataaactcgcgctacaaccattttgctttccccagacaggtgcgggaggtgaaccgggtgcacagcttctccatcactgtgcagtactacaccgcgctgctctcgctcgccatcgacgccttcttcatctcgtactacgggctcaactttgtgtcggtctgcgtgtcaatcttctcagtgctgctcgtcttcgagtggtactactgctgcaagctcgttgaagacctgcaggcaacggtgcgtacctagcacgacgacggacgcctaccaaatcctgtgtgtgaccctttctttctgtatctcctttcccgtcccacgttagaacaagcggatcggctggacgctgtataacgataaatggtccgactggctgcagtacgggagggagcagccggctgccttgcgcgagttccggaccaccctcagcatcatactgctcgcgacgcagcgcagcctgtccttgcgcggcagcgacatcgtcgaggtgtcgtggcaaacgttcgccagcatgctgaagacgagctactcggtgatgatgtttctgatcgagctgaggcggctgaatcgttga

SEQ ID NO: 209 - DNA, 1361 bp, Anopheles gambiae
atgaagttactagagctagacaaccctcgtgaagcaattgccatcggctgccgtctgctcaaactgttcggattggggcgggatgaacgattcaagctcgtttactggctccagtgtgtggcatatctggcgtttagtatcgtaccccgacttttggtagagatcgaggatatggtagcgctgatgcgccttattgcagagctggtgtttgtcgtttatctgtgtttgcaaataatggcactgtactgccgacggcgccagctttaccgactggtggatatgttgcagcaatgcatcgatataccctactcggagcaaatcgaatcgttcctcatccgatcgaacgtcaaaatcaaccaatcgtccgcagcctacgcgcggttcttcatgtgcgtgtacgtgctgtactgtacgatgtcaccgttagcgtcgggcttcgtctacattcgcaaccagcgcaatgcgacgggcgtgcaggaagagtttatcatcaccaccgaaatgaagcacgtattcccagctccacaatggacggtaatgttcctcatgctttttttcgcttgatcttacacagcttatacgacctggacatccgttacaatccgctgcactactcgatctacgccggtttgatatttgtgctgtcggcaatatcttcgctatcactctgcaccaaggacgttatcgacattgcagccattaaaacggtgacactggtgtttggcattgtaacgatgcagattcgtgacctgcacgagcagatcacccaggagcggttgaaccgtgtcatcaaatcgcatagcaacgcgctgtcttgcgcgacgcagctcgagcaggcactaaacctatccgttctgtttcagtttgcctcgtgcagcgccatctggtgtctgatgctgttctacattttgctaatggttcgcacctaaaaacacacacgcctaaaccttcccatttgacgtgatactaatgatataatttgtgttcaacgcttagggattggattcgcgtgttctgagtgtggtgttactactggtaattgtatcgatcgaaacctacgcctactgtatgctcggctcgcagttaactacacaggtaagaagcttttggggaagcaaatcaaaaagaatatctaatcatacaatcatacacagggtgaagatctgctaatggctttgcagcagctctcctggtacgaccaaccagtccccatccagcgacaaatactactaatgatacgacgctcgcaaacaccactcattctgagggcaggcaagctgttcagcgcaaacgtcgtgcagtttggtgacatcgtgcaaaagtcttactcctttttcttggtgctaaaaaatgtattctaa

SEQ ID NO: 210 - DNA, 1507 bp, Anopheles gambiae
atgtactatctcgaacagctccgtgcgctagtgagacgttatctcgagcgtcgctcgccagatccacgcatccaacatacgttcatcgtgcagagcattaaccgcgtcggtggtatgctcggtatcgacatctttacacccggctactcctccaccaatcttctgctgcggatggtcctgctgaacacgttcacctttttctggatcaatctctacagcctgaccaccacctacggcaatctggtcgactttatgtacagcttcgagacgctgctgtacgtgggcatcgcctgcatcaagatgtacgtgttcatcaagaacaaaacgctcatcctgcagatgcaccagtacatgatcgactttttcgaccacttccacggcgatcgggaacaggacgagctgctggtgcgaacactaaacaacacgaccctgctgtcgtcactgtttgcggtatgttccagctcggcgccgggcttactctttgtcggctcgctgctctggtccattgcggtggagtatgtgctgccgttcgggttctttatccctacggttggcatggatacgctgcaggggtacacgctcaactatgggtttcaaatgctcgaaactacgctgatggtgatcggcatcatctcgagcgagagtgcattctttatgtttcagcagaacgcgtgcctgcaggtggacatgctgcggttgcagctcagacggctgagcgaactgagtgcggctaacggtgatgggagcagcacgaaggagatatgaacccgcatacagacgatcattcagcatcatgtcgagcatttggagtaagtggttgttgacgagctttggatcggatcggaccacagggccaaagggcttaataacacgtcctcttctttctccaccgcagctactcgaaaagcatgtgcagcctgttcgaactgcacttcttcatcgtgttcgggtgcatcttctttcaactggtcagcaatgtcgtggtgattgtatcggtaagcatcggttgttgcggacgcacttgagccaagctaacgaatcgatgttcccattttgcttcgaaccaggttcccgattggtatcccgggtattttctgttcatcatgctaacagtccagctgttctttagctgtgcattgggagaaacgttcaacatcaaggtaagggtcgtgtatgcggttttgtgtatctcaatgtcctataaatgatcgtttgcattgtgtttcatcagagcgatgagcttacggtggcgatctacaacgtgccttggtacaatatggaagtacgcgaccagaaagcgatgcgcctgctgctgatggcttcccaaaatccggggcgactttcgtatggctttgggactgttaatatgcgtgccttttttgaggtacattcgaatgactgctcaaaatgtaagaagtaaacgttacgtactgttgttcgtttgcagattttcagaaagacctactccatagccatgatgatgatcagcgttaatgaggaagagtaa

SEQ ID NO: 211 - DNA, 1466 bp, Anopheles gambiae
atgatacgatttttcaccattcacaagccaccgggagtgccacatctcgcgttaaaactgcttcatgccgtaggaattgccaatggagaaacattttcgcatcgcttcaccgcagtgtatttgttgttcatttttatcatcgcgattcccaaactattctgcggctacacctccttcgaggcgtccgtcgtcgggttggccgagctattctttcagctcaacaactttactggcttgttactggttttggtaagtagcaaacagttacagtgcttggttcgagttggccaaactatcgctgacgaaggtaggcaatacactttcaaaaattatttcattgcgtgcattagtccttctacaatataatattattccgtgacagttttccagtgcgctcagactgatatgcgccagctgctaacgtcccatcacaagcgaatgcacacatagaccagatattactgtctagtcatcttgtacaccgttagcatttttgctaccgcaccaatttgcgccacgttctggtcgtacgttcgggctgctcatcggaacaccaccgcacagtacgtgctccatatggaggaagatttttacggactgcagattcgttcctcactgcgaagctgtcttatgttcgccatcccgatggtaccgacgtcgtacgtctgtgcatatgttggatgtgccaaaattatgatcgtcttcaatttcaccagctattgcaccgtctactttcggctggttgcactccaactgcaataccaaactcgaacagttccgtctgatcgtgatagcattagaacgatcgttgcgatgcaccagcaggcactgtgctgtgctgatttgttggaaaccatcgtatccccgatcatgctgatgcagattgtcctgtgcgttcttatgtcgagctctatggtactgtactttacattcccggtgagtgaacaaactgctactagcaaagatatatctatcagctatcttcttatgctcaaccttgcagactatgagcggccacatgataaatgtgttgttgctgtttttggttgtttcaaccgaaaccttcggctactgttacctcggtactcaactttcgatggaggtaacccctattgcataacacacacaaaagcatatcacacgcacgtatttattttttaaattctcatttacagagcgcacggatcgcatatgccgtatacaacggaaaatgggagcaacagccgagggagatcgcaaaacaccttcagctaattttactacgcgcacaaaagcccattggtataaccgccggcaagttttgcttcatcaacatggagcaattcgcaaaggtacatcatcataaacagctttccgtcaacgtattctataatgtttcaaaataataaggctatattgtctccacccccctgcagctccttaaaactacctactcagtgtttatcctgctgagagatttattgtaa

SEQ ID NO: 212 - DNA, 1826 bp, Anopheles gambiae
atggacattgtgagtaagcaaggtgaatttccgctggtaaaactctctacaaagttgttaagaatcattcgtttttggaacgattccccgggacaaaggattccttccttaggtttgctggtaactgccatatatccactaatatggcttatccctagctggttgtttcttgtgagctcgcaggacaatatcacacgtttcatgaaggcagctaacgagcagatagtgttctctcttatctgctgcaagttgtgcttctacgcaattcattttcgtcgttgggagaagctgtattacgatctgcaacgttcgtttagcaccgttctgaacaatccaaatctagagattcaaaccatattgggacacgtaacgaaatcgacccataagctcactaaatactactgttctacagtaagcttcaactgtgctgcgtacggcttatttccaatgttgttcatagtggttaaatatgccgtgacgggctcgtacgacgtgccgctttcaacaccgatcgaagcaaagtatgcaatggcaaataaaacttaaaattagcctgaaacactgtaatctgaaattgtgatgatttgtttggcaggtattttatccccggcctgcgtacaaacttttgggtttggttgccagtggatttaacactaaatgccatactggagttgcatgggtttgctttggttttcgttgaaaccttcacatggaatcttgtgtatgccacatcctgtatgtttcgaatcctgcaaatccaggtcaacgagctttcgcatcaaagtcgaaatgaaaaggaatggaatggcaagcttaaaacattcatagctctgcatgattctgtgctaaggtaagaaacaaatacatttcgaataacatgtacgtacagtagctatgatagtgtgtatcctactacagatcggctgaaacactggaggaaatattgagtttgcagatgttattactttacatatcgaccattttggctctgtgtctgggtatggtcgtgctgtctttggtaagttgttgcatttttcattcaagatttggtcgatcatgcttatgatcaaattcttagagtcgcttgttgaagtatcttcttcttcttctttggcacaacgaccgttgtcggtcaaggcctacccactggtgaagtaagcttagctagctttctttgacttattgattacccccatagctggatagtcaagtcctacgtatggcggcacggtccatttgaggcttgaacccatgacgggcatgttgttaagtcgtacgagttgacgactgtactacgagaccggctagatattatactagttaaacttaaaatggttaagaactcatgcttgcctaatggaattttttaatgttaccttatttcaatttcaaaaatgattttttttctcacggaacgctttcgttataggctgtcaatgaggtgtatgtgctgttgactaccatggccgtatttggctactgtatttttcaaaccttttccttctcttacctcggcactgagctcattgagcaaagcgaagcagtagcggatgcaattttccacagcaaatggtacacgcagaagctgaacagacagaaagacatgtgtttcttgatgatgcgagcaaataagccggtgaaattgactgccgccaagttgttcgttgtaacacgcgattccttcacccaggtaaattgtgaattctttgcactgaatgttttttttttataaactaacaatccttttggtgtttttgtaggtaattaaacaggcatacacaatctttacattgatgtcacagtttttggacaaccctgtgaattaa

SEQ ID NO: 213 - DNA, 2078 bp, Anopheles gambiae
atggacattgtgagtaagcaaggtgaatttccgctggtaaaactctctacaaagttgttaagaatcattcgtttttggaacgattccccgggacaaaggattccttccttcggtttgctggttactgccatatatccactaatatggcttatccctagctggttgtttcttgtgagctcccaggacaacatcacacgtttcatgaaggcagctaacgagctgatagtgttctcccttatcttctgcaagttgtgcttctacgcaattcattttcgtcgttgggagaagctgttttacgatctgcaacgttcgttcagcagcgttctgaacaatccaagtctggagattcaaactatattgggacacgtaacgaaatcgactcataaccttactaaatactactgttctacagtaagcttcaactgtgctgcgtacggtttatttccaatgttgttcatagtggttaaatatgccgtgacgggctcgtacgacgtgccgctttcaacaccgattgaagcaaagtatgcaatggcaaataaaacttaaaataagcctgaaacactgtaatctgaaattgtgatgatttgtttggcagctattttatccccggtctgcgtacaaacttttgggtttggttgccggtgaatataacactaagcgcgatgctggagttgcatggctttgctttgtttttcgttgaaaccttcacatggaatcttgtgtatgccacatcctgtttgtttcgaattctgcaaatccaggccaacgagctttcgcatcaatgtcgaaatgaaaaggaatggaatggcaagcttaaaacattcatagctctgcatgattctgtgctaaggtaagatacaaatacatttcgaataacatgtacgtacagttgctatgatggtgtgtattctactacagatcggctgaaacactggaagaaatattgagtttgcagatgttattactctacttatcgaccattttggctctgtgtctgggtatggtcgtgctgtctttggtaagttgttgcttttttcaatcaagatttggtcgatcatgctttatgatcaaattcttagagtcgcttgttgatgtttcttcttcttcttctttggcacaacgaccgttgtcggtcaaggcctacccactgatgaagtaagcttagctagctttctttgacttattgattacccccatagcaggatagtcaagtcttacgtatggcggtacggtccatttgaggcttgaacccatgacgggcatgttgttgaagtttaatatgtttaaaacggcacgcatgttgtgcaacattacagtttaaatctgttttttttttttaattattagatattatacttcttcttcttttggctcaacaactgttgtcggtcaaggcctgcctttacctcttgtgggtttggctttcagtgactaattgatccccccacatagcaggatagtcagtcctacgtatgacggcacggtccatttgaggcttgaacccatgacgggcatgttgttaagtcgtacgagttgacgactgtactacgagaccggctagatattatactagttaaacttaaaatggttaagaactcatgcttgcctaatggaattttttaatgttaccttatttcaatttcaaaaatgattttttttctcacggaacgctttcgttataggctgtcaatgaggtgtatgtgctgttgactaccatggccgtatttggctactgtatttttcaaaccttttccttctcttacctcggcactgagctcattgagcaaagcgaagcagtagcggatgcaattttccacagcaaatggtacacgcagaagctgaacagacagaaagacatgtgtttcttgatgatgcgagcaaagaggccggtgaaattgactgccgccaagttgttcgttgtaacacgtgactccttcacccaggtaaattttgatatcgttttattgaaagaatgtgtttataaaccaactattgttttggtgtttctacaggtgatcaaacaggcgtacacaatctttgcacttatgtcacaggttttggacgacacaatgggttaa

SEQ ID NO: 214 - DNA, 1272 bp, Anopheles gambiae
atgtccgctttggtgcatctagcaaaggatcacattcaacgcatcgccgatggtggccagtttgtgatcgtcaacggtatggatcggtttatcggattttttgcgtgggatgtgaaactaaacgcaacctggctgaagatgacgctgattgtgtttgccgttgggtacgaaatcaccgccatagctgccatggcgctggcctcagtaaaaggcgtctttacggagagaagcttcactatgagcttcgtcacaatgactggggccatgtgtatcgtgatttggttgtcgctggccgccttccgtcgcgatctgaccggaacagtcaagtttctacagcatcgtcagtgtactattcacagacagagcgcagctcgcaaagctctgatggaccgtgtcaaccggtatctgtggctgttctatctacagaacatagcgcaagtatttttttggatcaacctcctaaggaactgcagcccgttggcggtgttcgagctgtcgctgctggacagtgtaaatgtgctgctgtacccactggcgatgacgcttatgtcattgatgttcattcacacaataatgatcgtgtctacgttgctaagtgccctatcgcttgagttctactggttgggacaagagtttgagcaggtgtttgcccagtgcaatacgtttgccgctaccgcacggaagcgttactgggatgggctaaaacgaaggatcgacacttgcgttatcgagcatcagcgactgctgggacagatcagcacactgcgcaacaatttgaagctttatctgctgctgaatctcgttgccgatttctcgctcattacgtttgccggctgccagatggtcatctccagcgaaggagatcagcatctgtacagtattcttgctgcgttgaccgcatgcctgaatatgctcaatttcggtgggttgtgtgatttgctcaagattcaggtacgttgtgcggtgcgggagctttcgctatcccggaatacaactttccacattttacaggtgcatgcaatcaagtttcgcttgtacagctcccagtggacggactacttgcgccccgtatcggggcccctctatccgcgctgccgacgcatccggtccagcatactcatcgtgatgacccgggccgagcacgagctgcgcatcagttgtggtagcgtctacgacatgtccctcactacttgctgggccgtgctacagttcagttattcagtgtttacccttctgctaagcttcttcgaaaacgaaccgagagaccagtga

SEQ ID NO: 215 - DNA, 1394 bp, Anopheles gambiae
atggagtggttcagacagcagcgccacgccatttgtcatctacgggagggaagcgactatctacgctacctgcgcccgttccagctgatagccggctatccgatcaatccccgaccggcactctcgaaactggcgaccgtcgttcggctgctagcctacctgacataccttggcaccttgctgcacaagattagctacgtgctgtaccgccccgaggacattaactacgtgtcgttcgtgtccggtggcatcaccgtgctcgtggccgtactgctgctgatgctaatctttaccgtccactacgacgcgttccagcagttgggcacctttctgaacgaccgtgcgtttgcccgcgaccatccgctggcgaccggtatccgcgaccgttggtatcgctggagcaacggtctcatactgggaccgcagtgctgcatcgttctgattctcctgcaaacgtggatctcgcggcagcacctgaaaaagcacaccatgctggtggtgcgcggtgagccggtcggtaccgagtttgaccacttcctgtacatgagctgtctctacttccccacggtgggcttcttcatgggctgctcgatcgtgaacgcgatgctggtgggctttctcggcgagatggaactgttggccacctgtctgggggaactgttcgagacggttgagcggcaggtgaaggaggaaggacccactggccggccggatagtcgcgcgctctattggtccaccttgcacggcgagttacgccgatgcgcccagcggcattgtgcaattttcacgtaattctaacattcgttgagcattccgggtttccgaacgaaacacctaacgcacctccgcgtctctacaggatgctaccgaagttgcagcggatggccagcttcgtgtttctgcagcatcacatcttctcgctcgggctggtggtggccggctcctacgtgacgctgcgcggtccggcactgcgcgaaaacattgtgctcagtgagtatcccatctcggtcgtgctcgagtactttattttctgccagctggtcgagaagctgcaggatatggtaagtaacatgggggggggggcaaacgggatgaagaaagtgtcgcacccaggactgactttgtcgttcaatttcgctgccggtcacctgttaaagaaccgatcgattggcgatcggctgtacgggacggagtggatgctgaagctgcagtactcgagagactttcaacgagagtatcgatcggcggcgcttacgattcgattgctaattatgcgcagccagcaccgggtccggttcacctgcggctcgatcaatccggtctcgatggaaaagtttaccgaatttctcaacctatcctactcgatcgttatgtttctgcttagcatcaattag

SEQ ID NO: 216 - DNA, 1421 bp, Anopheles gambiae
atgatcgatcttgtgactcgcattcgccgaaagttgctcgccctggagcgtaagttagccaacgatctggatcaatttgtgcttctgcatcatctcacttttctgttcgccattcgcaatgatgcaccaagaggagtgggccaatttatgcgctggtgctttcatctgatggcgcccgtctttgtgctcagctcctactgctacaaagcctactggtacatgtcgcacagcgagtacagcttcgcactgttcaatgtcgtgggcactatctggatcatggctggtgcatttgtgcgtagactattgttcgatcgtggcctgctgacacgcctggagcagttccttaacgatcgcagctttcgtgaagatgaaccgctggtgcgtgcggctcggcagcatgtaaaggtgcagaacaatcgctacctgttcgcggtctgccttaccctagtgttggaggcatctattttttccggcacgaatctgatgcttcagccggagtttatgctcctttaccagggccacgctgtgggtggattcctcatccaactactgtacggttgggcgacctgcctctggggatcgttgtacgtgctgatctttgccttcatctacgtgctgctgaacgtgtttcgcggggagatgtcattgctggtggagtcgtttgagcgtattgacgaatgttttcataagtatcgcccagagctgaacactgcgtccgccggggagcgggaggaagagttttggcgcgagctgcaggcacttatcaagctgaacgttcagcgccacgtggagctgctggagtgagttgcatggagtgtgtcgctgtaagagttgctgcttcataattgcaccttcttttcaggaatttggttgattttggttcgattctcaaacccttctcattcatccagtactacggttcgtttacgctgatcgggtactactgcttcatcctaatgtacaaaggcgtcacaccgcttaccgtggtgtacattgcgttcatcgtttttcttgtggcggaatcgtttctgttctgtcgtatcttgtctcaaattaacgatcttgtaagtgaaacttttccctaacagttttaaaaaaatccccactctacgcaacactcatcgatctgctcactttgcttgcagcacgcgcgtattggtacagtcatgtgcgagctggaatggtacgacaagctgcgtttttcgacccggttcgcttcagcctaccggcagatgcgggcaagctttctgatcatcatcatccgatcgcagaagccgctatcgttcagcatcagtgccgctgggacgatctcgatggcgcgcttcgccgacctgctaaacagtagctactcgttgatgaccgtaatgtttcagctgaaagaaagaattattgccaagctgacttcggacggaaacaattaa

SEQ ID NO: 217 - DNA, 1403 bp, Anopheles gambiae
atgtggcatcaccaggtgcagttgtggtttcggtttctacttggacgattcaccacattcaccgacagttcagactacttcggtctgtacaaaacgctggcaacgatatcggccattcactacgatgcgtcttgctggttcgatcgagcgatctggatcgtctaccgatcgctgccaatcttggtgaacatctcctacttctacaaagcctatcggctcatcctgttccccgaagacaacacctcagccgccagcgttatcgcatcagtgtggggctttaccgaaggaacgctacgcatttgtctcatagagctgcggtatggcacgctggctagcattatgtcgttcctgaacgagcgatcgtaccggcagcaagattcgctggtgcgtcagcaacgtgccaccctgttcggcgagaacaaccgcatccagctcattctcgtcgccacaatgctgatggaagcgatctggttcatgacgacgcagctcttcagccgggatgcctttatgctgcaagtgaacggacacgtggtggacagcatagcggttcaaatactttacggcctgctgtcgaacgtgtggggcctaatctatgtgctttcctttgccatattctacatcatcatgaacacactgcatctggaaatgagcattctgctggacggcattacaagtgtacagttcacggttatgcgtcggttgaagcaacgaatggaaacgctagcggcgtccggacattcctcaactcaagttttctggagtattctacagccggagctgaacagccacatctcacggcacgttgatctccttgagtaagtgtcctttaaatgtgcttcagcttttttcaattcattgttacgttaatttgttcttcatcctcaagcaacctcaaagagttcagctctattgtgggcccattttccttcgtacagtactatggtaccttggcgctgattgccgactgtggattcattctttccatagagggtctgtcggcgaacggtatgatctacctgctgttcgttaccgtgttagtgtttcaatcgttcatcctgtgtcgcggaatcgagaagttaaatgatctggtaagaaactacaaagatatgattgcttttttaacgagccagagttatttcttattgctccaccaactccagaacgaagccattggacaagccctgtatagcgggtttgactggcccgacatgcttcaatacgatcaacgctttcgccgccagtacgtaaccgtgcggcatacgttaatgctcgttattggccgctcccagaaaggattccagtgttcgtacggaggcctcggcagcatctccatggaacgattcgcccagctcatgcagaaaagctactcgttgttaacgattttacttcagttcgccaagtaa

SEQ ID NO: 218 - DNA, 1396 bp, Anopheles gambiae
atggtgcgcagtcaaccgttccgtctgtccctggtacgcaagtactgggacaaatacttcaccttcaccgacaccgtggactatttcaacctgctcaacaccttcggtacactgttcgcgcttcactatcacacccgccagccacgctggacagtgaagaagcttctctggacagtttatcgcaccctctacctgctgtcgtatctgtcctactgttacaaagtgtactggttgttcagccactggcagtacagtacggctgcggccaatctgctcggtgcgctgggcctgtgcagcggggccttgctgcggctgctgctgatcgagcaaaactatcccaccgtacaccggctgcagcagtttctgaacgatcgaacctacctgcgcgaggatccgtgggcacgaaccgagcgttccaagctttaccgccacaacaatcgctttctggtggtgctcatcagcgccatcagcgtggagtcgctgtgctttctggcccggctgctgctgacgcggcccgagtttatgctgcagtacggtggagccgttctgggtggcccgtcagtgcagctcgcctacggcatggtaactgcctgctggggcatcatttacgtgctctcgtttatcgtgttctacacgctgctgaccgggtttcggcttgagatgcagctgctggcgcgttcctttcagcaactcgaggaaacgctcgtacccaccggcgtagggatggacgaccagaacgaatgggagtactgggacaacctgcaacagagactgacccatcggatcaagcgccatttggagttgctcgagtatgagtattcaaatagtgaaggttttccctgcaattaaaatgtatgttttttcatggtgctcttttccagaaatcttcgcatctttcgctcgatcgtcgcccctttcgcctttctgcagtactacagcaccttcggcctgatagcggactcgttcttcgtggtgtcctttgaaggttttaccggctacagcatggcgtacgtactgtttgcttcgtttctgatcctggaatccttgctgctgtgccgtggggtggaagatttgaacgatttggtaaggttcgaagctggtactgatgccttgcaatgatttccctacccatcaatcgatgcattcatttcatcagaatcgacaaatcggaaccattctgtacaacttcgattggccccggttgctgcgcttttccatccactaccgacgtcagtacttcagcgtacggcgaacgattctgctcgtgattttgcagtcccaacaatcgctccggttcagctacggtgcacatggggaaatttcaatgcacagctttgcggagctgatgcagaaaagctactcaatgctgacgttcatgctgcagttccaaaactaa

SEQ ID NO: 219 - DNA, 1428 bp, Anopheles gambiae
atgtaccttacgcagctattcgccagcatgcggacccagttcctgcaccgtatcactcactacaccaagcattcggatttcttcatcatgcagcgctactttgagaagatctacgccatccactacacaccgcatggctggcacgatcgtatcctctggtatctgtaccgtgcgctgtacggtctgatctatctgagctacatccacaaaacccactgggtactgcaccacccgcaggacagtttcagtacagcaaacatccttggcgtgatgtggttcttcagtgtcgtcattctgcgcgttgccattctcgagtggtactacccgttgatgctacgcatgcagacctttctgaataatcacacctcctaccagcggaccgatccatgggcggttggcagacgggcccgcttctaccgtcgaacgaatcgtgtgatactgaccgtaatgggtatcaacttggcggagacagtctgcttcactgccaccaacgtgatgaagctggatgaatttatgctgcagttccggggagcgatcgttggtggctggccggtgcagattgtgtacggcgtgctgaccatggggtttggcgggatgtactgcatgggtttcatgatgtgctatctgctactaagcatctttaagctggaggtggacatactgatacgttcactggaggaggttgaaagaagtgatcgtttggagagtgattttggagatagtgcagatatcttctggaataatattgtcgaccagttgagacctcatatgcaacgactggatgaattatttatgtgagtattgttgacaacttcacaacctaagcctggagactcataaatatcgacactgataaactaaatgcatgacagtagtcttcgaagactcaacagagctctaatttctaactacttcacaacagccaactccaacacctgaaagccgtcatcggacctatcgcgttcgtgcagtactacagcacatatctcatcattgcggactgctgcttaattctggtgtcgcatggactgtccagcttctcgatcgtatacttcatctccatgctggtgtttctcaccgagtccttcttgctttgccacggagtggaaaatttaagagacttggtatgacgaccgtttgtgttcaaagtgaagcaatctaaagcccaatctctttaccctgcagaaaccacgcattgcttcgacggtgtacgattttgactggatgttgcaaatgcgctgccctaacccgaggcaccgagctcagtatcgtcacgtacggcgtaccttgctcctgcttacagcccagtccgaccaaacgatacaattcagcttcgccggcatcggcgaaatctcgatgaacagtttcgcccagctcttggagaagagttactctatgctaacgtttttgctgcagttcgcaaagtag

SEQ ID NO: 220 - DNA, 1427 bp, Anopheles gambiae
atgttccatccatcccgatggatggcaaagtgccgcgtgtggtatgcagcgacatttaagttttctgcagatgctgactatttctttctcgtgcaaccgctctgccgatcgctgcaactgtttggcaatccagtgcgttgcttgcaggagttcggtacggttcgtggcctgttcgtacagctctgtcggttcctgtttttgctaccgtacgcttcattcgcgctaaaatcttactggcagctaaaccatccgttagatactaacaattccatccttacgtatggatcattcgtgatttacatgctttgggcgattctaatctgggtgctgaaccattacgagcacgaaatgtgtgagctaaggctctttttcaagaatcccacctaccaggagcaaagcgattgggctcaccgaatccgtgctggtaattaccgtcgatggaactggatgatactcatgttctatctgtttaacgtcataaacgtgtcgatcttcacgcttaccaacgcccataacaggcagtttcattttcaaacccggggtgaagtcgtgggaccgctgtattttcaaatcatcgtcgaaattttcactggctacttgagcttaggctactttgtaccctcctgcataacgctcatgacacttcagttatttcgaacggagatgcacattttaaccacaacccttaagcaagcggccaatgaagagcagcagcaacagcagcaccaacatgctgtcgacatccgctgcgcataccgttcgttttgcaagcagttttacgctaacattcggcgccacacggaactattgcagtatgtagtagagcaagtgaaaatgtggtgtcggtaagagaagtgttttaaaagctgcttctttgccatttgtcattccagatccattgccacgttttgtaaagtatttagccctatcagcgtggtgctgtactatggagctctcattacaataacatgcacatgcttttacgtaatgaagcatgacgtttctacaaccacagtctgctatgcaggatttgcagtttatatgctattcaatacgctactgttttgcaaaagcatcgatagtgttaatgatctggtaaggtgtattttcatgtctgacaattcttcgctgcgataaataagcaatcaccaattcctccaatctctccttcctatggcgaacagcacacggaggtgggttacattatgtacagcgagtactggccagcgacgctacagtatgcggaccagggcttgtcaaccgaaacactgcgacccttgcgccgcagtatattgatcgttttgcagcaaactttgcgaccgctccgattcggttacggcgtgtccggttccctctcgatgcaaagattcggagaattcatgcaacaaatttactcactgataatgtttctagctcagcttaattag

SEQ ID NO: 221 - DNA, 2546 bp, Anopheles gambiae
  modified_base (697)..(1052): A, C, G, or T
atggttaagtttttccgctgctgcaaagcaaggtaagtactagtgaactacaaactactgtgcttgtatcaagttttacaaacaaaaccaaactgctttactaattgcagagtgagccctgagctcttaagcaagaagaatgaaaagccggaagcgtttctaccgtcgttgcgtatgattttgttcatttttcgaatgttttacgcgtggccggacgagcaaagtttggcgccaaatgcgctctggtggtaccgtgcaaagggtgtgctgtttcgtacgtttttcatatatctttcagcagcagcgcagctggcttacaacttcacagtcactagtcgtgaggtgagtagatgtgtgctaaacatgtaacttatttaaaatgagtcattgtactgcacaggaactgtttgctggcatgtttgtgctgcttacccagctcgtactgatactgaagatggagtttttctacaaaaatgtgtccaaaattcagcagctcatccgaagactgaacggcaagcggtaccaacagtcgggaaatgctgaggaagacatgtaagtagctgtattgttatttcaaacgtgattcattactatacagggtttcccacgatttattggttggttcccacgatttattggtgcgttcccacgattttttggtcatttcccataattttttggtagcaacccacgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttgggaaccgaccaataatatttgggaaccgaccaataaatcgtgggttgctaccaaaaaattatgggaaatgaccaaaaaatcgtgggaacgcaccaataaatcgtgggaaccaaccaataaatcgtgggaaaccctgtaatgcaatgcaatgacctccaattcgcacgttcccaactgacaggccgctggtgagtgcgcgcaagaagtcaaccatattctggaccttgtacttcatgttctccgttgggctggctacggagtggttagtgatatcgctgtcgctcaccactttgatagtgccggtgtggcccgtcgtagatcataccacaccgtactgggtatatttaatggtgatcttccatcagtatgtggcaattgctcttaacgcttcgtttaacatctcatgggactcgctcgtggcagcactgttcgcgctcactaacgcgcatcttcatcgactgcaaatacagcttatgaaggtgaagtagctaggtgggaaagagggttgagttgattcgacattaatatagatgctaatttttagctaggacatcggaaacatctacatccgccgaaggatgctaagaggcgtatgattgcggtctcttccttcgatgataatgctcggagcgttccaaccaaatcagatgcagatgaagtatacaacgaactactgcaatgcattatctttcatcaggaagtcactgggtagatagatagataagtagaaagggataaattgcccggaaatcgtccttcaaactgtccgttgcattctccccatttcttcggcagatttcttcgcgaagtcctcgacctgttcagtggaccgctgcttgcacaactgtactgttccgtgtttatcctgtgcattaccgagtttcgtttgctcacggacgtgaacacaatggcagatacggtgcaggcggtaatttacttgctgtgccttgtcatacaagtggcacaatactgttactttggcaatgaaatcaactatatggtaagtatttaggtaagaaagaatgtagagctcacttcactagtaggtacagacaggccttgatcgacagcggttgttgtgccaaagaagaagaagaatgtatatagaattttatttgcatttactacaatttaaggcccaaaaggtacaccgagcgaccgcttttgtgaactatccggatatgaacatcaaatgtagaaagcttctaatagcatttcagcagatgtaagctttggaaagctttaagtattaaaaaccttcaaattttaacactcttttgtaccaattccagcactgctgttggaataaagtgtagtgcaaagtatgtttttacaatccaactgagcatggagacatttgtaacggtaagcatcaatggtaaggggcaagcgtattagaagaaacgcgctattaatatttctcttttcgcacagatactcaaaacatcctactcgtatttggcagttttgagatcgatgacggattaa

SEQ ID NO: 222 - DNA, 1438 bp, Anopheles gambiae
atgagtttgagttttaagcgttggaaggcagtctgtttccgcccacaaaagcagtcagtgtgcagcgcgcgtacgatggaggcgtccgagaaatttagccagtttgaacgttatatacgcaccctttgcaacataatcggtttcgatgtaatgaccgaaacgtggaaaaagtcgtaccgaacgtacatgtcgatctttctttgctcacagtacttgatattgatggtttactcgctgatcattgccagcgacacgttcgagctgttcaaatccctctcatttttgggatttttctttcagtgttcgctgaagatgtactacacgatccagcaagcacctcagtatgcggtgaatttttgctgcctgaaggaagcgatctacgagcgtcactcgaaagggaccctagcacaaaagacgaccgttgcccggatcatagatctgttggtgctcgtgacgaaagccatctcagttctttatacttcgtccttgtttattttttcactgtatccggcttatatgtactttgtggtacatgtgaaggtaccgatctttccactgtacataccggggattaacatttactcggcgtacggttatggcatcaccaattcgtttcatatgttgatcgctgtgtacgggttattcggtgcactaacctcagatattgtattcattatgtttgtggtgcatttcgttacttatggggggctgttcaagattgagtgtgaacagtttgaccaggatctgagtggtgttttccagcattgtgagtggcgaacagcagtatataaaacgttctgccgccaacggatgcgcgccatctatcagtatcatcaaagcgttatcttctatctggagtctatgcaggagtgctatcgaaatatctgcgtagtgcaggtggcctcgtgtagtttatcgaccgtattcaatctatttttggccttgacagtaagtggaggctctatcggctacgtcgaaatgtataaaggtcagcgttgtttcctcttccagacggattggtacgcaacgtacggatttattgtgatatctgtgtttcaactgtttgtgtactgcttgatgggaactgtgatgcaaataatggtaagggatttagggtcagggtacaatcacataatgcaataaccgttttaatatcgtccagtgaattaataaacaataataataataacggtatccatttctatctttctattaacagaacgaacgaatgattgattacatctcgaatctgccctggtatatgctcccaaccgaagagcagaagcagtttaagtttatgctcgcacgcagccagctttcagcagaaataatgatccgcagtgtcggtccgatgaacatggaaaccttcactgacattatgcagaagatgtactccgcatttgccatgatgtacagttttctggttgatcttggctag

SEQ ID NO: 223 - DNA, 1432 bp, Anopheles gambiae
atgagttcgagttttaaacgttggaagccagtctgtttccgcccataaaagcagtcagtgtgcagcgcgcgtgccatggaggcgtccgagaaattctgccagtttgaacgttatttacgtaccctttgcaagataatcggtttcgatgtgatgaccgaaacgtggaaaaagtcgtaccaaacatacatgtcgatcttgctctgttcacagtacttcatattgatggtttactcgctgatcattgctagcgacacgttcgagctgttcaaatccctctcatttttggggtttttctttcagtgttcgctgaagatatactacacgatccagcaagcacctcagtatgcggtgaatttttcctgcctgaaggaagcgatctacgagcgtcactcgaaagggaccctggcacaaaagacgaccattacccggatcatagatctattggtgctcatgacgaaagccatctcagttctttatacttcgtccttgtttattttttcactgtatccggcttatatgtactttgtggtacatgtgaaggtaccgatctttccattgtacataccggggattaacatctactcggcgtacggttatggcatcaccaattcgcttcatatggtgatcgctgtgtacgggttgctcggtgcactgacgtccgatattgccttcattatgtttgtggtgcatttcgttacctatggggggctgttcaagattgagtgtgaacagtttgaccaggatctgagtggtgttttgcagcactgtgagtggcgaacggtagtatataaaacgttctgccgccaacggatgcgcgccatctatcagtatcatcaaagcgttatcttctatctggagtctatgcaggagtgctatcgaaatatctgcgtagtgcaggtagcttcgtgtagtttatcgaccgtattcaatctatttttggccttgacagtaagtggaggctctatcggctacgtcaaaatgtataaaggtcagcgttgtttcctcttccagacggattggtacgcaacgtacggatttattgtgatatctgtgtttcaactatttgtgtactgcttgatgggaactgtgatgcaaataatggtaagggatttagggtacaatcacataatacaataacagttttaatatcgtccagtgaattaataaacaataataataataacggtatccatttctatctttctattaacagaacgaacgaatgattgattacatctcgaatctgccctggtatatgctcccaaccgaagagcagaagcagtttaagtttatgctcgcacgcagtcagctttcagcagaaataatgatccgcagtgtcggtccgatgaacatggaaaccttcactgacattatgcagaagatgtactccgcatttgccatgatgtacagttttctggttgatcttggctag

SEQ ID NO: 224 - DNA, 1369 bp, Anopheles gambiae
atgtacactgcgatcgaattctacaacgccagctttaaccggcttaagctttccagtcggctgatcggtgcgggcttgtgggaaaagcaggaaggcatattatggggtcgggtcgcgagcgtgatgcagatagtgttgtttttgactttgcatgcttggacgggctacaagtatcgttatgatgcgctacagatgctcgagacgcaatcgctcatctgtaccggtgccgcgttgatgatcaagtactttacgatgattcggaatccggccccggtccgtgagctttcgggcaatattgaaacgcagatgtacaccaagtatcaggagatgagccccgagtatccagtggtgctgaagtatggacgggtattgtacattgctgggcacatcatgatcggaggatactttggttcgttgtttatcatatggatcaatccgctgatcatgtattttaaagaaggtcgtgtgatgttgctgtttttctgcgaaattccgtacgtcgattggacggtgatgaaaggctactggactacggttatattgcagcttttcttctacatcaccggaacgtgcggattgattttggtcgattatttgtgcgcatatttcacgatcaacgggtcactgtacgtggacattttgcgctttcatctagacgaactcagcgagctgctagctagtccgggttatcagacgcgcaactcgccggaaattatggcgaaggtgagccgcaaatggagaatgtgtctcgtggagcatcaacgcatcgtagagtgagtggaaagtgtgttgtttaaaatgtatggctcgattacgatcacgtttcaccgatgtttcagatattatgataatttttccgacctgtggagtatgattaacctagcacaagtgggttgcagtgtgtttgggatctgcatcaatatgctgattatttttctggtaatgtacatcgtaagagcagaagtataccataattcgagattcttgttactttccttacagaccgattggtatgcggcgtatgcaattttgtttgcactgttcatagacttgtcggtacattttgtgctaggggctatcatcgagagaaaggtcggctaggggctatcatcaagagcaccttgcactaacagtgcaaagtacctgtagttttgtttttccaaataccttgatttattcacaaatgcatactttatccctccaggttgacgatctgcatattagtttgatgcatttcccttggtatttgatggacgataggcgacagaaagaatacaagctgctactattacgtgcgcaacaaccatctggaatgtcgattgctggtctcacgccagttaattatgaaacctacactcaggtgcgatag

SEQ ID NO: 225 - DNA, 1492 bp, Anopheles gambiae
atggcaactgttgaaagttttcggcagctattacaaccactaatcttctactctaagggtgtaggagtagaaatatggactgctcctggaaaatttgtaccagcatcttactatctttcgttacatgtggccatatacttctctagcacggtattcactttgattaagtatagcgacgatacgttgcacatgatgaaggctctaattacgctgggcacttgtgtacaggtatagttcggatgcgtttgaactcgaaggtaagctcagttgttacttttgtctttcagctgtacgtcaagttcatcatcggacataaaaaggcaagtgagctcaagttacttagcgataacattgagcaggctatcctgcagcgctatgaaaatggaaaagcagaggaaattgccgtactgcaacgtactggccgtatactttggtttatttttcgtttcatgcgcacatcggttagtagcgctgcatttggattctttttatatccagttattgcttactatacgaccggggaactgatgcctttgttcatgatcgagcttccctattacggttggacaactaccataggactagcgatgaacatgttttgtcaagcgaatatattggtgattggaacgatgggagctataatgtccgactttctattcttcatgtacgcgatgtatgcaatgacatgcattgatatttttattgtgcacctatgtgagctagagacgctgctaaaagagattcatattcatgaaaaggaatgtgcaaaacaaacatcaataatgcggcaaaaatggattcagtgcatgcaagatcaccaacaagctactaggtgcgtttgtatggagctttcatacgaatctctgatgttgtttcagcttatatttttaaacatttttctatgaagctttctaaatacgactgaagacattttcggaataacgtgtttagcacaagtgcttatgggaatattcacggtctgtgatggaatgctactggtagctttggtaagttgaagctagcgacgatacaaacttggttctttaacaattaaaaaatgttttttcttagacattttggtttcctacctattgttttctgttggtgatgtttgtcgagctttcaatttactttgtgattggacattttgtagaactgaaggtacaactatacgttgagggacgataagagtgtcacaagattgataagatttctgtctacgtagatcgatgaaatgtacaacagtatcatctcgatgccgtggtataaactaccagtggaggaacagaaggaattcgcctttctgatgtgcagacagcaacgccccatgatgttaacagcttatgggtttctcaccatgaacttcgagtcatacatgagtgtaatgttttatattgttttaatccttcaaatggatgaatatagtagttgttactttgcaggtattgaagggtctgtatcaattttttgtgatgatcatgcagtacgttga

SEQ ID NO: 226 - DNA, 1478 bp, Anopheles gambiae
atggcaaccatcgagagctttcgtaaattgttgaaatatttgatagtgtactcgaaagtgcccggggttgaaatgtggactgcgccgggaaagttcaagccagcctcgtattatgtttcatttcatataatagtatattttgtcagcactgtttggacactgaaaaagtacagtgatgatccaattcatatgatgaaagtccttataacgctgggaactgctgtacaggtattattacgaaagaagtaagattatcgactgtttaagtattgtgtttcatttttagctctacatcaagttctttgtgggacattcaaaatcaaaggaagtgattgttttctctaacaaaatcgagcaggaagtgtttgagcaaaataaaaatagaactgctggagaaactgttctgttgaaacaaactggttatattctttggtttttttttcgttttgttaccacattagctactatcgttgtactagcatttgggctgtatccattgttcgcgtataatgtaaatggagtagtgatgcctttgttcctgtacgagctaccatattacgattggagcactactattggatatgttgtgaacatgatgtttcaagtaaacctgctggtgatcggtacgataggagccatgctgttcgacttcttgtactttatgtacgcgatgtatacaatggtaaaggcggatatttttataatacatcttggtgagctagagaaaatgctaaatgatccgctgacaatgaagaaaaaccaatccagtgtacgggaaaaatgggtgcagtgcatgtttgaacatcagcagactaccaagtaagttaaacagagcttgcattagcattattctcgattaataaacgtttgatctaacatctagcttcctgaattccatcgaagacattttcgggctcatgtgtctagctcaagtctccatgggagtatttacgatatgcgatgcaatgctactggtagcattggtaagtatttttaccttctatacttctatatttccaatttacaatatggtgctacgttgttggacatttcagacggattggtatcctacatactcgttcttattggttatgtttatcgaactgtcattatattttttgataggacacttgatcgaacaaaaggtatgtttttacaacaggacatggatattatttgcgattttattgatatttgcttgttgcagattgacgcaatgtacaacaagatcatctcaatgccttggtttaagctcccagtgaaggaacagaaagaatttagatttctgatgagcagacagcaatgcccgatgatgttgactgcgtatggttttcatcccatgaatttcgaggcgtacatgagtgtatataatagttcatagtcgagtatatttaaagccttttatagtttttgttactttgcaggtgttgaagcgtctgtaccagtttttcgtcatggtcatgcagtatgttggctga

SEQ ID NO: 227 - DNA, 3493 bp, Anopheles gambiae
atggcaaatgttaaagattttcgtaaattgatgaaatctctgattgtgtactcgaaagtggccggggttgagttgtggacagcaccaggaaagttcacgccagcttcgtattacgtttcgtttcatataacagtatattttgcaagtactgtttggacactaagaaagtacatcgatgatccaattcgtatgatgaaagtcctcataacgctgggaactgctgtacaggtaggaagtgttgaaatcaaaatgatggattatatgatctgagtacctacgtatacaatgtatttatttttagctctacattaagttcttcgtttggcattcaaaaccccaagaagtcaagttatttaccgctgaactggaacaagaagtgcttaaacgctaccaggacgggtctgaagaggaaactgctgtacttagacatacaggtcgtattctttggatagtctatcgtataatgagtgcgtcatatatcttcgctgcagttgcattcggagtgtatcctgcattttattactttgtaacgggagtagtgatgcctttgtttgtgtacgagctaccgttctgcgatttgagttcttctttaggatacgcagtgacgatgtgttttcagattaatctcttggttattggtgttttgggagcaatactgtctgattttgtgtttttcatgtacgcaatatatgctatggctaggacagagatttcaatattgcatcttggtgagctggaaaacatgcttatcgaccccaataagaatgaagaacacactgaggatatacgtcgcaagtgggtccagtgcatgcacgatcatcagcaatcaaccaggtgagtctaagacagcatagatcgatcgatccagattatgtgattatttcttcactttttgtaaagctttttcagcacgattgaaaacttattcgggcttatgtgtttagcacaggttgcaacagaatttctttcaatatgtgacgcaatgctattagtgcttttggtaggtactggtaagattacttatattatgaagtgtatatgacaaatagtatgtgtttgaaaaacgtttcaaagagttgaaatttgttttagaacgtatgaagttcattgtctagacttatttcgatgttgcgtaaaaactttttatggaaaaggttatcattttcgtttattatgttggttttgaatagatgttatatctgttatgtctacccttgaatttaaaaataattaataatgtggacaaaattatttatagctcgtgtttttccataaaaacataaagaaattttaaaagaaatagttgcatataggatattatttgttgacagttacaaacaaaatgaaacataactactttaatatttacaaacgttatggctggtggtttgtaagtaattataatataatcgaactggttagtaaaaaaaagattattcgcaatgcagtgaatggtattgttaggaagtcgcaaatataaaaggaactgttaagctcagtcttaataaaatccttctgagctagacagaatatcatttcagtataaagcatgttgatgacgtatttggtttaaaaactagttcaacataactaaggtgttctaaacatgcagttttttatattgttctgtttacacggaagggtcgtgaaaccctgtttctactgcatgggcgtcagacgttagattaacactagaaccgcctgacttttcaatcttactaaaaccgccatatgggacaattttgtcccattcgttatgtgtacatatttagacatgttaattatttcctaagggtttcatgtggcaaaaaaattgataaactttataattaggtgtaataaatcattataagggacactcagacgaaccagtgctactaataaaattgcgctagagtgtacggtagaatgcttttatagactagccgattgaatatagcgaaaacataagcacgtagtaagcaagagtaaaagcacgtatgtagttgaatactttcgcgcacttttattgttctattcgtattgacatgccttgtcacgaaaacgcgtacacgccagtgctgccagacttgcagaagtacacccgtcactcgttgacagcagggatgccagccatcacaatttattttgcttcttcttcttctttggctcaacaaccgttgtcggtcaaggcctgcctgtaccacttgtgggcttggctttcagtgactaattgatttccccccatagcaggatagtcagtcctacgtatggcggcacggtctatttggggattgaacccatgacgggcatgttgctaagtcgtacgagttgacgactatactacgagaccggcttattttgcttatgggacaaaaatatcccatatggcggttttaggttgaaaatgattttttttttaattaccatatgagatacaattttgtttataggtgcattcaatagatcgttaaaaataaatagaagtcagaaattttcaatgagttgtcccgatggcaaacggaataacacacctttctcgaatgcgatgggacaaaaaagtcccatcggcggttctagtgttaagatgtgcttatgtattataattaaagcgagtgtcatgatggaatttagaactgaaatgcacatcgaagagtaaacagatagaggttctcgagaatgatgcacaaaaaataatcaaaaatatcatcacaagcgatcctgatgaccaaaaggtattgttttgttgaacgcgcgatggccacggcgaccatcaaataccgcttgaggaatgtctgcgttttgttgacatagactcttatcgcactgtgctagttctgagtgccaattgttttagcaaatttagcttctttagctacagaatgttaaaattatgtaaagaataataaggccacccactgttaatgatgtagtacaacaattaccaaagttgtatggtttaatggtatatggtttaattgacgaaaacaacttatctaggcattatcaataattaaacgaacattggccatttcataaagatctaacatgtaatgtaacgatattgattttgtatattatgccgcagactgattggtacccaacatattcctacctgtacgtgatgttcgtccaattatcaggatatttcgtgattggacatttggttgagataaaggtaaaataaatatgaactatactgcatgtgtagtatttttgacaaacatgttacttatcacagattgacgcattgtacaacaagatcatctcgttgccttggtataaactaccagtaaaagaacagaaggaatttagatttcttatgagcagacagcaatatccgatgatgttgacagcgtatggctttcatcccatgaacttcgaggcgtacatgagtgtatataatagttcatagtcgagtatttttaaagccttttatagttttgttgttactttgcaggtgttgaagcgtctgtaccagtttttcgtcatgctcatgcagtatgttggctga

SEQ ID NO: 228 - DNA, 1541 bp, Anopheles gambiae
  modified_base (1046)..(1051): A, C, G, or T
atggcaaatgttgagggctttcgtaaattgatgaaatcattgattgtgtactcaaaagtggccggggttgagatttggacagcaccaggaaagttcgtgccagcttcgtattacgtttcgtttcatataacagtatattttgtcagtactgtttggacactaagaaagtacatcgatgatccaattcatatgatgaaggtcctcataacgatgggaactgctgtacaggtaggaacatgatgaaatcaagattatggcttacgaatacaatgtatttacttttagctctacatcaaattctttgtgggacattctaaagcccaagaaattatgttagttaccgctgaattggaacaacaagtgcttaaacgttatcaaaatgggtctgagcaggaaattgctgtgcttagacgtacaggtcgcattctttggatagtctatcgtatgatgagcgcgtcatatattttcgctgcagtcgcattcggactgtatccagcattttattactttgcaacgggagtagtggtgcctttgtttctgtacgaactaccgttcttcgatttgagctcttctttagggtacgcagtaacgatgtgttttcaaattaatctgttggcaattggagttctgggagcaatactgtccgattttgtgtttttcatgtacgcaatgtacgctatggctagggcagacatttcgatagtgcatcttagggagctagaaaacatactcaataatccctctaagaatgaagaacactctgcagaattacgtcacaagtgggtccagtgcatgcacgatcatcagcagtcaaccaggtaaagtaagacaagattgaacgatgttccaggatatgtgattgtttgttcatgttttctaaagctttttcagcacaattgaaaacatttttggactcatgtgtttagcacaggttgcaactgcaacattatcaatatgtgacgcaatgcttttggtgcttttggtaggtatactatattttgataatggtaggttaactaaaatggttaagtaagttttacaaaaannnnnntaaaaaatctaatagaacctagtaattatatggtggtttgtattttattgcagactgattggtatccaacatattcctacctgtatgtgatgttcgttcaactatcagggttctttgtgattggacatttggtagagcttaaggtacaattatcatacacaatatggtatgcgtagtttttctgacaagttataacttatttttaatagattgacgcaatgtataacaagatcatctctatgccttggtataagcttccgttgaaggaacagaaagaatttagatttcttatgagcagacagcaatgtccaatgatactgacggcgtatggctttcatcccatgaacttcgaggcgtacatgagtgtatataatagctcataatagtttattccagtaaatggttgtatatacttttattttctttgcaggtgttgaaggttctgtaccagtttttcgtgatgatcatgcagtatattgacagaaactga

SEQ ID NO: 229 - DNA, 1535 bp, Anopheles gambiae
  modified_base (1044)..(1049): A, C, G, or T
atggcaaatgttgaagaatttcgtaaattgatgaaatctctgattgtgtgctcgaaagtggccggggttgagatgtggactgcaccgggaaagcttaagccagcctcgtattacgtttcgtttcatataacagtatatttcgtcagtactgtttggacactaagaaagtacatcgatgatccaattcatatgatgaaggtcctcataacgatgggaactgctgtacaggtaggaacatgatgaaatcatgattatgaaatcaatttaacgcacgctattactttctttctatttattagctctatatcaagttctttgtagcacattcgaaagcccaagaagtcaagttatttaccgtggaactggagcaagaagtgcttaaacgctatcaaaatgggtctgaggaggaaactgctgtgcttagacgtacaggtcgcattctttggatagtgcatcgtttgatgagtgcgtcatatatcttcgttgcagtcgcattcggactttatccagcattttattactttgcaacgggaaaagtgatgcctttgtttctgtacgaactcccgtttttcaatgtgagctcttctttagggtacgccgttacgatgggttttcaaattaatctgttggcaattggagttctgggagcaatactgtcagatttcatgtttttcatgtacgcaatgtacgctatggctagggcagacatttcgatagtgcatcttagtgagctggaaaacatacttaacgactccactaagaatgaagaacactctgcaaatgtacgtcacaagtggatccagtgcatgcacgatcatcagcaatcaaccaggtaaggtaaaataacattgatcgatgttccaggatatgtgattgtttcttcatgttttctaaagctttttcagcacagttgaaaacatttttggactcatgtgtttagcacaggtttcaactgcaacattgtcaatatgtgacgcaatgcttttagtgcttttggtaggtatactgtattgtgatactggtaggttgattataattattaannnnnnaaaataatctaataaaatctaataattatatggtggtttgtatgttattgcagactgattggtacccaacgtattcttacctgtacgtggtattcgtccaactatcagggttctttgtgattggtcatttggtagagcttaaggtacaattatcataaactatgcgctattttttctgacaagttttaacttacttataacagattgacgcattgtacaacaagatcatatctatgccttggtataggctaccagtgaaggaacagaaggaatttagatttctattgagccgtcagcaatgtccgatgatactgacagcgtatggctttcatcccatgaacttcgaggcgtacatgagtgtatgtaataaatcgtttattatttgattatagtaaatggctttatacagttgttttgtttttgcaggtattaaagggtttgtaccagtttttcgtgatgatcttgcagtatattggcagaaactga

SEQ ID NO: 230 - DNA, 1522 bp, Anopheles gambiae
  modified_base (1028)..(1033): A, C, G, or T
atggcaaatgttgaaggttttcgtaaattaatgaaatctctgattgtgtactcgaaagtggccggggttgagatatggacagcaccaggaaagttcacgccagcatcgtattacgtttcgtttcatataacagtatattttgccagtactgtttggacactgagaaagtatatcgatgatccaattcatacgatgaaggtcctcataacgctgggaactgctgtacaggtaggaagtgttgaaatcaagattatggcctacatataatgtatttacttttagctctacatcaaattctttgtgggacattctaaagcccgagaaattaatttatttactgctaaactggaacaagaagtgcttcaacgttatcaaaatggatctgaagaagaaactgatgtgcttagacacacaggtcgcattctttggttagtctatcgtatgataagtgcatcatatatctttctggcagttgcattcggaatgtatccagcattttattgctttgcaacgggaaaagtgatgcctttgtttctgtacgagctaccgttctgtgattggagctcttccttggggtatgcagtaacgatatgttttcagatcaatctgttggcaattggagttctgggagcaatactgtccgattttgtgtttttcatgtatgcaatgtacgctatggctagggcagacatttcgatcgtgcatcttggtgagctaaaaaacatgcttaatgaccccactaagaatgaagaacgcactgcggaaattcgtcgcaagtggatccagtgcatgcacgatcatcaacagtcaaccaggtaaggtgagaaagcattgttcaatttctcagattaagtaattgtttctttatgtttttaaagctttttcaccatgattgaacacatttttgggcttatttgtttaacacaagtcgcaacagcaactttttcaatatgtgacgcaatgcttttagtgattttggtaggtatacaatattatggtactgataggtttaggtcaattgacacgtnnnnnnaactacatcgtaaaatctaataaactagattatatgatagtttatatctttttgcagactgattggtatccaacatattcctacctgtatgtgatgttcgttcaactatcaggattctttttgattggacatttggtagagcttaaggtagaataatcctaaacgatccggaatgcgtagtatttcataccagttacaacttacttatcacagaatgacgcattatacaacaaggtaatctctatgcctcggtataagctcccagtaaaagaacagaaggattttagatttctcatgagcagacagcaaaacccgatgatgctgacagcgtatggctttcatcccatgaatttcgaggtgtacatgagtgtaaataataatccttagtttttggtttcagtaaatggctttatataattgatgttattttcgcaggtgttaaagcgtctgtaccagtttttcgtgatgatcatgcagtatgttggctga

SEQ ID NO: 231 - DNA, 1374 bp, Anopheles gambiae
  modified_base (186): A, C, G, or T
atgaccgttgtgcaccgcatcgttagctttggctacaacctgctccagcgccacttcaatgttggacatcctacggaacagttcttcttgctgcgctgtctggacgttgtatcccgtcagtttcccgtgatcgagttgaagttttttcacaagtaaaagcattttaaaaatcctttacttctcccnagcggccatgctactacagcgcccacgctcgaatctggaggtcgccctgaagacgctctgcttgagcgtgatggtagcgcacaccatagcgctggcgtacgacttcagccagcagacggatgtgcgtcttgcgatggacatgctatgcatgctgtcactctttgtctccatcattttgcgtggcacctgcatgcgccagtacctggcgcacattaacgcactggaccggctggaaaggcggccaacgtttcgcatcggcacaccgtacgccgatgagagccgccgaaacgttgcgttgcagaacagtcgctacctcggcgtggccctcgtgtttcactcgctcacggtaacagtctacgtgatccagaacatggtgagggaaaattcgttcgtgaagatcattaccagcttcccgatcgacctgtccgagcgggcaccggtgctggagcgggtggccgacctgtgctacagcctcgtcgggtacgtttggggttggtaccatggggccacccagctaaccatcatcgtcctgctgcgctacgccattaccgagtttcgcgtgtttctccactcactggacagcctggacgatcagctacaacagcgtcgcgaacagtcgcagggagctccggacgaggagcgcatcctgcgggagctgctgtacgagcacgcacggcaccactcgcagctgatcgtggtcgtgacgcacctgcgtacgttgctgcgcaactactcgctagtgcacttctccttctacatgatcatcgtggccacctttatgacgcgcgtccttatcatccccggcaggtcgtcgttcggcttggccatcccgctgttggtgacgacgatctatttcctcgaaacgttcggcatgtgcatgctggtggagatgctggtgcagttggtatgtatcaaacaggtgaacaggctagctttctaatcccacaaaacacgtcgtttctgcttcagaatcgaaaggtcagcaccagcttgtacggattcagctggccccagtatctgcgctacggacgcaccatcaaacggccgatgatgctgatgataatgcaggcaaacatgacgaaagatttctccgccggcgggctgaccacggtatcggccgagctgtttgctaaaacgtgccgaatgatctacaccatgatgatgtttatggccaatatggcaacgtag

SEQ ID NO: 232 - DNA, 1374 bp, Anopheles gambiae
atgaccgtagtgcaccgcatcgttagctttggctacaacctgctccagcgccacttcaatgttggacatcctacggaacagtttttcttgctccgctgtctggacgttgtatcccgtcagtttcccgtgatcgagtaggaattttttcacacgtaagcgcattctaaacatcctttacttccccccagcggccatgctactacagcgcccacgatcgaatctggaagtcgccctgaagacgctctgcttgagcgtgatggtagcgcacaccatagcgctggcgtacgacttcagccagcagatggatgtgcgacttgcgctggacatgctatgcatgctgtcactctttgtctccatcattttgcgtagcacctgcatgcgccagtacctgtcgcacattgacgcactggaccggctggaaaggcggccaacgtttcgcgtcggcacaccgtacgccgatgagagccgccgaaacgttgcgttgcagaacagtcgctacctcggcgtggccctcgtgatgcactcgctcacggtaacgatgtacgtgatccagaacatggtgcgggaaaattcgttcgtgaagatcattaccagcttcccgatcgacctgtccgagcgggcaccggtgctggagcgagtggccgacctgtgctacagcctcgtcgggtacgtttggggttggtaccatggggccacccagctaaccatcatcgtcctgctgcgctacgccattaccgagtttcgcgtgtttctccactcgctggacagcctggacgatcagctgcggcagcgtcgcgagcaggcgcagggagctccggacgaggagcgcatcctgcgggagctgctgtacgagcacgcacggcaccactcgcagctgatcgtggtcgtgacgcacctgcgtacgttgctgcgcaactactcgctagtgcatttcttcttctacatgatcatcgtggccacctttatgacgcgcgtccttatcatccccggcaggtcgtcgttcggcttggccatccccctgttgacgacgacgatctatttcttcgaaacgttcggcatgtgcatgctggtggagatgcttgtgcagttggtatgtatcaaacaggtgaacaggctagctttataatcccataaaacacgtcgtttatgcttcagaatcgaaaggtcagcaccagcttgtacggattcagctggccccagtatctgcgatacggacgcaccatcaaacggccgatgatgctgatgataatgcaggcaaacatgacgaaagatttctccgccggcgggctgaccacggtatcggccgagctgtttgctaaaacgtgccgaatgatctacaccatgatgatgtttatggccaatatggcaacgtag

SEQ ID NO: 233 - DNA, 1238 bp, Anopheles gambiae
atgggtacggcaaaccaaccaacaagcatctgcttccttcgatggatcggctggatggacacgatcaacgggatccatctgcacgacgattcgcgcctagctcgggcgttcgagtacacgttttacgcccttcagctggtgcagcttctgaatgggtacaatttcgcagtgctttgcagcaacgacaccatctcgctcgaaacgtttgcggaacagttcaaccagttcggtggtattttactgaccctgtcccgtgtcatcgcgattgtaggcagctttccgcgcgtttgatctcggttgcacagggtactgtgatgatatggtttatctcattttttttccagaatatttatcgtccccagctgaaagacacggccgagttcatcaatgcctgcaaatttcaccatcttaacgagcgagcagaagagatccgtgccggatccattcacaacgcgggccgattcctgtccacgctcctagccgtccagatagtaacgcttattttctggttcgtgctaactgagctgcaggcccaccggcaggacgtgctgctgcccatattcatctatctaccgtttgacgcttcccactggccactagtcgcaaaggtagcgtttcggctgtacgcttacgtagcgtttgcgtacgctcagctgatgcttacgttcttcggaagctatatcatcacgagcagctacctgctaacgcttaccatcgagcttcgcatcctgaacgattcgtatgctgctgcaccgaccgatccgcagcagttagtagcattcctgaaggaacgggtcgtctacaaggcggcactgctgcagcacatccgaaccatcaagcgacacatgaacgggagcgttctgctggagctgctgtttatcgtgtgcctgcttgcgctcaatgggttacgcctgtgcaccaccaccaccaccagtgatcttagcgagctggcactgtccagcagcatgatcctgatctatctgctggagctgttccagtactgctggcaggtggatgagatggagctgctgcacgagggtcaagcgttcgccgtctactcaacgccgtggacgggtgccatcatgcagtcgaaaccattcctgctgatcacgatccgtatggcccaggtgccgttgcgcttcatgtgcggtaggatgtatcaactgtctaccgagctgtttacctccgttgtgcagtttatctactcactcattatgatgcttttacagtttaagtaa

SEQ ID NO: 234 - DNA, 1377 bp, Anopheles gambiae
atgaccgtagtgcaccgcatcgttagctttggttacaacctgctccagcgccacttcaatgttggacatcctacggaacagtttttcttgctgcgctgtctggacgttgtatcccgtcagtttccagtgatcgagtcggaattttttcacacgtaagcgcattctaaacatcctttatttccccccagcggccatgctactacagcgcccacgttcgaatctggaggtcgccctgaagacgctctgcttgagcgtgatggtagcgcactcaatagcgctggcgtacgacttcagccagcagacggatgtgcgtcttgcgatggacatgctatgcatgctgtcactctttgtctccatcattttgcgtggcacctgcatgcgccagtacctggcgcacattgacgcactggaccggctggaaaggtggccaacgtttcgcgtcggcacaccgtacgccgatgagagccgccgaaacgttgcgttgcagaacagtcgctacctcggcgtggccctcgtgatgcacttgctcacggtaacagtctacgtgatccagaacatggtgagggaaaattcgttcgtgaagatcattaccagcttcccgatcgacctgtccgagcgggcaccggtgctggagcgggtggccaacctgtgctacagcctcgtcgggtacgtttggggctggtaccatggggccacccagctaaccatcatcgtcctgctgcgctacgccattaccgagtttcgcgtgtttctccactcgctggacagcctggacgatcagctgcggcagcgtcgcgagcagtcgcagggcgccccggacgaggagcgcatcctgcgggagctgctgtacgagcacgcacggcaccactcgcagctgatcgtggtcgtgacgcacctgcgtacgttgctgcacaactactcgctagtgcacttcttcttctacatgatcatcgtggccacctttatgacgcgcgtccttatcatccccggcaggtcgtcgttcggcttggcccatccccctgttgacgacgacgatctatttctttcgaaaacgttcggcatgtgcatgctggtggagatgctggtgcagttggtatgtatcgaaaaggttaccaagctagctttctaatcccacaaaacgcgtcgtttatgcttcagaatcgaaaggtcagcaccagcttgtacggattcagctggccccagtatctgcgctacggacgcaccatcaaacggccgatgatgctgatgataatgcaggcaaacatgacgaaagatttctccgccggcgggctgaccacggtatcggccgagctgtttgctaaaacgtgccgaatgatctacaccatgatgatgtttatggccaatatggcaacgtag

SEQ ID NO: 235 - DNA, 1238 bp, Anopheles gambiae
  modified_base (340): A, C, G, or T
  modified_base (640)..(645): A, C, G, or T
atgggtacggcaaaccaaccatctagcatctgctttcttcgatggatcggctggatggacacgatcaacgggatccatctgcacgacgattctcgcctagctcgggcgttcgagtacacgttttacgcccttcagctggtgcagctgctgaatgggtacaatttcgcagtgctttgcagcaacgacaccatctcgctcgaaacgtttgcggaacagttcaaccagttcggtggtattttactgaccctgtcccgtgtcatcgcgattgtaggcagctttccgcgcgtttgatctcggttgcgcagggtaatgtgatgatatggtttatctcacttttttnccagaatatttatcgtccccagctgaaagacacggccgaattcatcaatgcctacaaatttcaccatctcaacgagcgcgcagaagagattcgtgccggatccattcacaacgcgggccgattcctgtccacgctcctagccgtccagatagtaacacttattttctggttcgtgctaactgagctgcaggcccaccggcaggacgtgctgctgcccatattcatctatctaccgtttgacgcttcccactggccactagtcgcaaaggtagcgtttcggctgtacgcttaccttgcgtnnnnnnacgctcagctgatgctgaccttcttcggaagctatatcatcacgagcagctacctgctaacgcttaccatcgagcttcgcatcctgaacgattcgtatgctgctgcaccgaccgatccgcagcagttagtagcattcctgaaggaacgggtcgtctacaaggcggcactgctgcagcacatccgaaccatcaagcggcacatgaacgggagcgttctgttggagctgctgtttatcgtgtgcctgcttgcgctcaatggtttgcgcctgtgcaccaccaccaccaccagtgatcttagcgagctggcactgtccagcagcatgatcctgatctatctgctggagctgttccagtactgctggcaggtggatgagatggagctgctacacgaaggtcaagcgttcgccgtctactcaacgccgtggacgggtgccatcatgcagtcgagaccattcctgctgatcacgatccgtatggcccaggtgccgttgcgcttcatgtgcggtgggatgtatcaactgtctaccgagctgtttgcctccgtggtgcagtttatctactcactcattatgatgcttttacagtttaagtaa

SEQ ID NO: 236 - DNA, 2566 bp, Anopheles gambiae
atggtacgtctaagctttgaagaaacgcttcgaaacaccaacctgatgctactgatgatgggcattccaccgtgcgaggagccgtacccgccgggcgtactgccgtcgctcaaacgcaacgcgggcttcatcgcgtccttcctgctgctcgcctacaccacgatcggtgagctgatctatctgaagcagatgttcgagcgggacgttaccttcctggaggtaacctttcaagcgccctgcatcgggtactgcaccatcggtgtgctgaagatggtcatactggcccggggaaggaacacgatcgccgagctggtcggtttgtttcgcgcaaagtggacgtcggcggtaagcattttcttgtgccagtgctggaaaatgcttttaaataatgtaaattctcctttcaccagattgtaaccggtgcgcattgggcggtgtgcgaggacacaatgcggcccgccattcgggtcacctcggtaacggcgctcgcgaacgtcgtgatggggatagcgttcaccatcctgccgatcgcggagatgatctacacccatcactacacgggccggtggaaccgtcagcttgccttcaacatctggtggccgttcgatgtgctgggtggcgtaaagtactactggttcgtctatccactgtacgtcgtgattgggttcacgggcatcatcatccatatggcgttcgactgtttgttctgcatactggcggcccatctctgtatgcagtttcgcatcctggcgcacaactttggccatgtggtagaggttgccaatggtgctcgtgaaggtgacagtggcagtacgagtcggctacgggatgcgatcagaatccatcaggagttgattgggtacgaaggaaccccattggatgcgggagtaaatcaatggcgtaagtaatgcatcttcattttcatccgcagctgcagcgtgttcatgcagaacgtgtttggcaatgcgctgtttattaacttcctcggcagctccatcataatctgcatccaggcgtttatgataacggtaacatgtagtgttgtagtgacgcacctggagtcgtctggagtctgctttatcaaagaggcgcccaccaccaaagcacccccaaaatgttgtacgtgaatgtacaggaattgcagaaaccctggcgttagatacacaccacacgatcgatctaatcatggcacgtgcaacatctcaagcaaattgcgcgcgcgcacacgcaccccaagcttatcttatcggcaaaattagtatttaccgtttgaaagcggcttcccttcctggctgtttctcactctctctctctctgtctctctgcgtgatgccgtatgcgccgcgtgctataggctagttatgcttaccggatgttgcgatcgcgcacgtgcttttccgcatacgccagtgcacacttgatggcggtggtgatgacgtctgctgcgcaccgttttctgctgtgagtcagaccttttcatttcctgcaatatcctgtttctttcccgaccccacagacggttagcggatatatgctggtaaagtttgtcctcttcatgctgtgctttctgatcgagctgctgatgctgtgtgcgtacggtgaggatattgtggaatcggtaaggcaccaggcggtgatgagcgagtcgcgagtaattgaagcttttgcttttaaaacacatcagagccttggggtgattgatgccgcttacggttgcgaatggtaccgggaagggtcggtggcgttccatcgatccgtgctgcaaattatacaccgcagccagcagtccgtcatactgaccgcatggaaaatttggcccatccaaatgagtactttcagtcaggtgagttgccaattgattgccgtttgcgttaatatttcagtaagagtgcgctctttcccttagatcctgcaagcttcctggtcctactttaccctcctgaagaccgtctacgggaataagtaagcgcgagagagagagagagagcagtatcgttcaccctttggatgaatcaatagatttctaatcatgaaccattgaaaaatgaatcaacattttcgctagttgcacaatattgtaccattctatacagcttcaccacgaccaagcgtttgttgcatcaggaccaaacacgtttcgacaagccgcgtcacctgctggctggtaaaggtggtaaacacaacactttgactcaccgtttgtgtaacgtaacgttacaaaaacaaaacacaaacccctacaccgccgtctatcagctgttgaggtggggcagtcgtaaaaaatagggagtataaaaaacaaacaacaccaagcaaacccttatcgcgtaccggcgcgcaccggcaaaccccaataatggccgacagagcgagtgcgatgaggaaaagtgcgatgaccaatgggaaaactattcgcgagccataagcttatcaggtttgatttgctttcgtcactgtttcgccggtcaagtcacgagttttgggtgggtcgaagtggtggtggtgttggtcacccttatctaatcgcgttgcgcacccgatcggaaaccaccaccacgtcacagag

SEQ ID NO: 237 - DNA, 1964 bp, Anopheles gambiae
acaggaacgacggttgtgatccctccactggtggtgacacgaatcataagcattatttcatacctaaaaaacaaaatctacaaaaaaaagcttcattcccatcgaaaaaactttcttgtgaaatcaaccgagctaacaaacaacatcctgtgcaaaatctagcagtgaaagtgtgatatcgtatacctgtacctgtaaaccgttgtgcgcgtgtgtgcctttgtgtatcaattttgtggaaaacagaaaatacatcaaaatggtttacaatttcaaagtcttcaagaagtgcgcccctaatggaaaggttacgctgtacatgggcaagcgtgactttgtagaccacgtttccggcgttgaaccgatcgatggtatcgtcgtcctcgatgatgagtacattcgtgacaaccgtaaggtattcggtcagattgtctgcagtttccgctacggccgcgaagaggacgaggtgatgggactaaacttccagaaggagttatgcctcgcttccgaacagatctacccgcgtccggaaaagtcggacaaggagcagaccaagctccaggagcgactgctgaagaagctgggttcgaacgccatcccgttcacgttcaacatctcgccgaatgctccgtcttcggtcacgctgcagcagggcgaagatgataatggagacccgtgcggtgtgtcgtactacgtgaagatctttgccggtgagtcggaaaccgatcgtacgcaccgtcgcagcaccgttacgctcggcatacgcaagatccagttcgcaccgaccaagcagggccagcagccgtgcacgctggtgcgcaaggactttatgctaagcccgggagagctggagctcgaggtcacactagacaagcagctgtacctgcacggggagcgaataggcgtcaacatctgcatccgcaacaactcgaacaaaatggtcaagaagattaaggccatggtccagcagggtgtggatgtggtgctgttccagaatggtagctaccgcaacacagtggcatcgctggagactagcgagggttgcccaattcagcccggctccagtctgcagaaggtaatgtacctcacgccgctgctgtcctcgaacaagcagcgacgtggcatcgccctggacggtcagatcaagcgtcaggatcagtgtttggcctcgacaaccctcttggctcaaccggatcagcgagatgctttcggcgttatcatatcgtatgccgtaaaggttaagcttttcctcggcgcactcggcggcgagctgtcggcggaacttccatttgtgctgatgcacccaaagcccggcaccaaggctaaggtcatccatgccgacagccaggccgacgtagaaactttccgacaggatacaatcgaccagcaggcatcagttgactttgaatagacgacgcaacggtttggaaatgctacctactaccccaggcatgggctaacacgacgaacgaactactactactaagcataaaaaacaggaaaaaaaatggaaaacttaaaaaatggatcatacaaccgaacgcaaacgacctacgacgatcgatctcacttccccgtctttttcatcctaagcaatagaacgatggtagaaaaggaagataaagatggagagaaagtcacgtgtatcaatgacgacgactaccaaaactgaagacgtaacacatgttccccagcgagcggtaactgttctgttctgacaccttccgctcgacaatgtaccttttaaaaacatacaaattagaagtcgtcttcactaccttcaaccaatccagccactttggtatatacttttcatagaatccttctgagcgcaaggaccctattgaaattcagtgttattttgtaactgcgaccaaatgcctagctgaatgttgttgaacgagttatgtacatcaaaagattgaataaaacaaaaaaaaaaaaaaaaaaaaaaaaaaaaaaaa

SEQ ID NO: 238 - protein, 383 aa, Anopheles gambiae
MVYNFKVFKKCAPNGKVTLYMGKRDFVDHVSGVEPIDGIVVLDDEYIRDNRKVFGQIVCSFRYGREEDEVMGLNFQKELCLASEQIYPRPEKSDKEQTKLQERLLKKLGSNAIPFTFNISPNAPSSVTLQQGEDDNGDPCGVSYYVKIFAGESETDRTHRRSTVTLGIRKIQFAPTKQGQQPCTLVRKDFMLSPGELELEVTLDKQLYLHGERIGVNICIRNNSNKMVKKIKAMVQQGVDVVLFQNGSYRNTVASLETSEGCPIQPGSSLQKVMYLTPLLSSNKQRRGIALDGQIKRQDQCLASTTLLAQPDQRDAFGVIISYAVKVKLFLGALGGELSAELPFVLMHPKPGTKAKVIHADSQADVETFRQDTIDQQASVDFE

SEQ ID NO: 239 - DNA, 5543 bp, Anopheles gambiae
ggtaaagggctggatgaggagaggagacttatatttttggaagcctttggtaggtgacaagggggagttagtgataggggagtggggccaaaatagggaggaggtaaaatttatggtacgccccataggggaagaggaaagtgaccagagcaggccagtgtccccgctggggggctcaacggtgagccggctgtccctcggcgggggaatgaaacccttacaaaataaaaactagcgtttttctactctctcaaatgtccaaagctgttgctcaactgggtgctgaaaacccctgcgttatgcaaagcattagtcagctgaaggtgcaaaatcttccacagcttgcataaaggagctgctgatccgtagcttgtccgtgcaagatcatacgatctttataattcgcaaattcgccttcccttcttaatcctttatgacgcccgtgttggttcgctctttcctgcgacacacggtgctcagccaaacgtgacctaaacacgcaccccacagcgtacgcgtgacgtcacgaccttttgcgttttcgcggggaaataagattaacgttcgctgccgacgcccgttgaccgttgcatcgtaatttcgtataccgttctgcgcgtgtacccctgcgtacgtccaggctgttgcgtatcgcaccatcgtacgcgaacggaaggcatcggggaaagggacgcaaggatgggcatgaattagctgacactatttgtcccctcccccgtaatgcaggcgcaaccacctggcagctcgtcggtggcagtagctcgagcctaattcagttaatggcaatcgggcaagcgtcgatcgattttcccgctgcaaaagcccgcacgskkwysgtccgggaaaccttttcggtgttttcagtgtacggtccaccacacgggcggtaaaaaggtataaaactgtccaccagccgaccgttcgatcgcacttctggttgttctttcaaaccatacaatacccgaaactagctgagaactttgtagttcaagcaattgaaaaaacgcaagaaaacagcgctccgtagaacgaccccggagaatagacacgcaattttgtacgaccaatctcgaagcgagtgaattgagggagtgagctaccgtgtgtgagaatactcgtgatacatttcgaaagttctatctgattgtttgctctgtgtttgcgaagacacaaactaacgcgcagtgatggttgtcgcagtgaaagtgtttaaaaaatccgccccgaatggcaaactgaccgtctatctcggcaagcgtgacttcatcgaccacaccgactactgtgacccgatcgatggcgttatcgtgctggacgaggagtacctgcgaggccgcaaggtcttcggccaggttggtttactggaagatctcgatcctcgatgactgcagttcaggaagtctttaagaacttgttaagtgamcagatatgattctttcgagtgtctacttactagatgagtgaatatgtgtgcaatttggaatgaactctcaaatgcctggagcagaagcagagtatcgataacttggaattacaatcaagcctcgttaattagccaatactcatgttgccatgttctgaatttatcagatctttgaaaggttcgaggatattatgaagataatagtgcagacggccaatacaaaggacctattatcgttctattgctgaaccacaatgttacagcgtttgatgaatatcatccgattagtttcaatacaatccaattagtgaggtgacatactagaaggacacacaactgatgtcataatgtagttgaaatgaatgctaatatcaagggtattaaaggtttttaatgaactccaactcattggataactctttcgaagaactttgatgtctcagaatagccgaattcttatcttttactaacatagttgcaagttctcagcatgtaactgttctccaacccacttcaatgttccatttctctctctctctctctctctctccccgcagctcatcaccacctaccgctatggccgggaagaggatgaggtgatgggcgtgaagttctccaaggagatggtgctgaccaaggaacagatctacccgatggagaacgccaacatggagatgacgcccatgcaggagcggctggtgaagaagctgggcgcgaacgcgttcccgttcaccttccacttcccgagcatggcgccgagctcggtgacgctgcaggccggtgaggacgacacgggcaaaccgctcggcgtcgagtacgcgatcaaggcgcacgtcggcgaggacgagagcgacaagggccacaagcgcagcgccgtcacgctgacgatcaagaagctccagtacgcgccggtgtcccgcggtcgtcgtcttccttcgtcgctcgtcagcaagggcttcaccttctcgcagggcaagatcaacctggaggtaacgctcgatcgggagatctactaccacggcgagaagattgcggccaacatcgtcgtgacgaacaactcgcgcaagactgtcaagagcatcaagtgcttcgttgtgcagcactgtgaggttagtagtgatggagcattcctgggagggggcacctagatgtgatgatcgggttaatttaactccctaatcattccctcctgcattytaggtcagcgatggtgaatgcacagttcagcaagcacatcgcctcgctggagacscscgagggttgcccgatcacgcccggggcgagcttcacgaaatcgttcttcctggtcccgctcgcctccagcaacaaggaccgccggggcattgcgctcgacggccacctgaaggaggatgacgtcaacctggcctcgtccacgctgatcagcgagggcaagtgtccgtcggatgcgatgggtattgtcatctcgtactcgctgcgcgtcaagctcaattgtggcacgctcggtggcgaactccagacggacgtaccgttcaagctgatgaacccagcacctggtaagtgtcgtaagggagcgaacttcgtacatcatcgaatatctggtgctaatgcatatttttttcctatttctctattatcaggatctgtcgagcgagagcgcgtgaacgccctgaagaagatgaagtcgatagagcgtcaccgttacgagaactcgcactacgccgacgatgacgacaacatcgtgttcgaagactttgcccgcctgcggatgaacgagccggagtaagcctgtcccgcctgatgcggcattcacykrcaaccatccttcaccccaagggcgaacggctttaatccggagaggggacagcaaatgccatgtcttctgttccatttcctccaccgagcacccgagcaggcagcaaacgcaaacatgaagaaaacacacacgccccaaaaatcctcccaatgcttttccgcgccaagtatgctttctttcatgcccttttaatgctcccaggagcggtacgagcgtgcgtgtgatggctgggcggggacgaacgagtgtccctcggggggacccttcgtctaggctagcggctagagtggtggtcacctgagagacgctcatcagcctttcccagccgtaaccacacgtaacmatgtccaatgtgataacactgatgatgctatttaaattattaaacgcaaaaaacacggcgccgctaagcaacgaacactagagcgcgcgataaggaaacagcaagaagaagaagaagaagaagtagtagagaaaaaacctatctagtgaaggaacaacctaccctataagtgctcccccaaaaactataacgatatatgaagtaacgagagaaaaacgacatgaaaatgaggagtgttaatggtagcctccgccaaaaaacaaacaaacgactaacgaagccaaaacccccttcctaaaatcacaacaagcaaactaacgattatgaaatggtcaacaccaaatagacaacaaatttgattcatcgattaattccctgccggagaaactgtgccgagaagttcccgagaagaaaaccagaacatcaacgactgcgcagtcaagaggtggggcaacgcgaaccagcaactcccttgggaatgcagaatccccaactgggggtgcgatggttacaatcctcctcaatcgaagaacacgcacatgagtaacgtgcagcaattaatcgatcaatcgaagagcaacttacatcgaaaaatgtttaaaaacgaacaaaaaaaaatatcataaccatacacaagaaccaagccccaaaamcccaagcaaacaccagaagtgaacgaaatcgacgataatctagtgcagctccggktcgtacgtggacgcttttccccggkttggctatggtgraaaccggccmcatccgaaccgctggcgacagcagccttagagtgtaagacgttttatgtttctgttttgtttttcgtggtgagacagcaattggagcaggcaatttaagggaaacgagcaaacgatttaggcaaatggaagctagaagcaacaaagacgcgcgcagaggaagaaaaaaacagacaagaagataaaaacaaaaccacacgagcaatgaatgcaacgaatgcggttgggaagtgaagagctaaggaaaacggtgcggagaaatggacatgaagatgtccttttcccggtaccgttttcacttccgattcattcaccccaactcgttcagcgctccttactgcgagtcaattattgtttcagattgtgttcgattggttgatataagcttgttcatgcaaaatgggggtttttcttatctaaggaaaccatgctatattattacctgcaaatgcaataggaacagagcagaaaggaaactttataatcmactaaaatywaaccmaattaattggaaaagagaaaaaaaacccacaacttcaaaccaatgcaacgacctattgatacatttgaaacaaacccaaaggtcacgcaacacatagagtcagttttgagttttgcgatgtacagtggactgttagtagctgtgtttattttgtataaatctaatttggctatgttattattgtaattggagaaaaaatgctgagcaaccaaaaaaaaactaacttacaaacaaaccagcaactattgaatttgtttttatttgttccaatttgtactgttttttcaggtttctttttttgcgtttggtcgggaggctttcggccaacggtccacaggtagtagagggggaaagaaataactggttgatggaagaaaaaaaaaaagcaacccttaccctaactctttgtaaagatatgtatacgaatgcaccggtatttgctcaattagaatgtattccctttttgctggaagataggggaaggattgggatggaccgttttctgtttctagagaacaatttactgcaacgagtgtgatattcaaggatgtgataatgcattttccagcagagagttggagttggcactattgtgattgtaatttgaaactttgaaactattacaaataccaaactttccttataaagggggaaattctgaaaagaaaaatcatatttcaccccagttgggctaaaaccatttg

SEQ ID NO: 240 - DNA, 1190 bp, Anopheles gambiae
atggttgtcgcagtgaaagtgtttaaaaaatccgccccgaatggcaaactgaccgtctatctcggcaagcgtgacttcatcgaccacaccgactactgtgacccgatcgatggcgttatcgtgctggacgaggagtacctgcgaggccgcaaggtcttcggccagctcatcaccacctaccgctatggccgggaagaggatgaggtgatgggcgtgaagttctccaaggagatggtgctgaccaaggaacagatctacccgatggagaacgccaacatggagatgacgcccatgcaggagcggctggtgaagaagctgggcgcgaacgcgttcccgttcaccttccacttcccgagcatggcgccgagctcggtgacgctgcaggccggtgaggacgacacgggcaaaccgctcggcgtcgagtacgcgatcaaggcgcacgtcggcgaggacagagcgacaagggccacaagcgcagcgccgtcacgctgacgatcaagaagctccagtacgcgccggtgtcccgcggtcgtcgtcttccttcgtcgctcgtcagcaagggcttcaccttctcgcagggcaagatcaacctggaggtaacgctcgatcgggatctactaccacggcgagaagattgcggccaacatcgtcgtgacgaacaactcgcgcaagactgtcaagagcatcaagtgcttcgttgtgcagcactgtgaggttacatggtgaatgcacagttcagcaagcacatcgcctcgctggagacgcgcgagggtgcccgatcacgcccggggcgagcttcacgaaatcgttcttcctggtcccgctcgcctccagcaacaaggaccgccgggcattgcgctcgacggccacctgaaggaggatgacgtcaacctggcctcgtccacgctgatcagcgagggcaagtgtccgtcggatgcgatgggtattgtcatctcgtactcgctgcgcgtcaagctcaattgtggcacgctggtggcgaactccagacggacgtaccgttcaagctgatgaacccagcacctggatctgtcgagcgagagcgcgtgaacgccctgaagaagatgaagtcgatagagcgtcaccgttacgagaactcgcactacgccgacgatgacgacaacatcgtgttcgaagactttgcccgcctgcggatgaacgagccggagtaa

SEQ ID NO: 241 - protein, 398 aa, Anopheles gambiae
MVVAVKVFKKSAPNGKLTVYLGKRDFIDHTDYCDPIDGVIVLDEEYLRGRKVFGQLITTYRYGREEDEVMGVKFSKEMVLTKEQIYPMENANMEMTPMQERLVKKLGANAFPFTFHFPSMAPSSVTLQAGEDDTGKPLGVEYAIKAHVGEDESDKGHKRSAVTLTIKKLQYAPVSRGRRLPSSLVSKGFTFSQGKINLEVTLDREIYYHGEKIAANIVVTNNSRKTVKSIKCFVVQHCEVTMVNAQFSKHIASLETREGCPITPGASFTKSFFLVPLASSNKDRRGIALDGHLKEDDVNLASSTLISEGKCPSDAMGIVISYSLRVKLNCGTLGGELQTDVPFKLMNPAPGSVERERVNALKKMKSIERHRYENSHYADDDDNIVFEDFARLRMNEPE

SEQ ID NO: 242 - DNA, 122 bp, Artificial Sequence
  Description of Artificial Sequence:Synthetic pUSAT promoter
gcatgcctgcaggtcggagtactgtcctccgagcggagtactgtcctccgagcggagtactgtcctccgagcggagtactgtcctccgagcggagtactgtcctccgagcggagactctagc

SEQ ID NO: 243 - DNA, 19 bp, Artificial Sequence
  Description of Artificial Sequence: Synthetic Primer
atgaagctgaacaactgaa

SEQ ID NO: 244 - DNA, 20 bp, Artificial Sequence
  Description of Artificial Sequence: Synthetic Primer
ttaaggatattaacaccatt

SEQ ID NO: 245 - DNA, 27 bp, Artificial Sequence
  Description of Artificial Sequence: Synthetic Primer
gatcgcggccgcaagctgaacaactga

SEQ ID NO: 246 - DNA, 30 bp, Artificial Sequence
  Description of Artificial Sequence: Synthetic Primer
gatcggtaccttaaggatattaacaccatt

SEQ ID NO: 247 - DNA, 34 bp, Artificial Sequence
  Description of Artificial Sequence: Synthetic Primer
agatctgccaccatgaagctgaacaaactgaacc

SEQ ID NO: 248 - DNA, 29 bp, Artificial Sequence
  Description of Artificial Sequence: Synthetic Primer
actagtttactctgattccatgctctgaa

What is claimed is:

1. A method of identifying an agent that modulates an odorant receptor, comprising:
providing a nucleic acid encoding the AgOR7 mosquito odorant receptor of SEQ ID NO:13, wherein the nucleic acid is operably linked to a promoter;
expressing the AgOR7 odorant receptor in a Xenopus oocyte;
exposing the oocyte to the agent; and
measuring a modulation of the odorant receptor.

2. The method of claim 1, wherein the agent is a composition from human sweat.

3. The method of claim 2, wherein the composition is selected from a group consisting of 2-methyiphenol, 3-methyiphenol, and 4-methyiphenol.

4. The method of claim 3, wherein the composition is 2-methyiphenol.

5. The method of claim 3, wherein the composition is 4-methylphenol.

6. The method of claim 1, wherein exposing the oocyte to the agent is providing the agent in a liquid medium.

7. The method of claim 1, wherein measuring the modulation is recording action potentials wherein an electrode is inserted in the Xenopus oocyte.

* * * * *